United States Patent
Kley et al.

(10) Patent No.: US 11,084,859 B2
(45) Date of Patent: Aug. 10, 2021

(54) TARGETED MUTANT INTERFERON-GAMMA AND USES THEREOF

(71) Applicants: Orionis Biosciences NV, Ghent (BE); VIB VZW, Ghent (BE); Universiteit Gent, Ghent (BE)

(72) Inventors: Nikolai Kley, Newton, MA (US); Jan Tavernier, Balegem (BE); Frank Peelman, Gentbrugge (BE); Lennart Zabeau, Zwijnaarde (BE)

(73) Assignees: Orionis Biosciences BV, Ghent (BE); VIB VZW, Ghent (BE); Universiteit Gent, Ghent (BE)

( * ) Notice: Subject to any disclaimer, the term of this patent is extended or adjusted under 35 U.S.C. 154(b) by 0 days.

(21) Appl. No.: 16/344,668

(22) PCT Filed: Oct. 24, 2017

(86) PCT No.: PCT/EP2017/077193
§ 371 (c)(1),
(2) Date: Jan. 9, 2020

(87) PCT Pub. No.: WO2018/077893
PCT Pub. Date: May 3, 2018

(65) Prior Publication Data
US 2020/0055912 A1 Feb. 20, 2020

Related U.S. Application Data

(60) Provisional application No. 62/411,823, filed on Oct. 24, 2016.

(51) Int. Cl.
*C07K 14/57* (2006.01)
*C07K 16/28* (2006.01)
*A61K 38/00* (2006.01)

(52) U.S. Cl.
CPC .......... *C07K 14/57* (2013.01); *C07K 16/2887* (2013.01); *A61K 38/00* (2013.01); *C07K 2319/30* (2013.01); *C07K 2319/33* (2013.01)

(58) Field of Classification Search
None
See application file for complete search history.

(56) References Cited

U.S. PATENT DOCUMENTS

| | | |
|---|---|---|
| 5,574,137 A | 11/1996 | Gray et al. |
| 5,914,254 A | 6/1999 | Mascarenhas et al. |
| 8,980,267 B2 | 3/2015 | Grewal et al. |
| 9,139,634 B2 | 9/2015 | Morrison et al. |
| 9,534,056 B2 | 1/2017 | Grewal et al. |
| 2010/0172868 A1 | 7/2010 | Morrison et al. |
| 2010/0297076 A1 | 11/2010 | Morrison et al. |
| 2011/0081341 A1 | 4/2011 | Honjo et al. |
| 2011/0104112 A1 | 5/2011 | Morrison et al. |
| 2011/0224407 A1 | 9/2011 | Langer et al. |
| 2011/0274658 A1 | 11/2011 | Silver et al. |
| 2013/0064791 A1* | 3/2013 | Poelstra .............. A61P 43/00 424/85.5 |
| 2013/0183298 A1 | 7/2013 | Le et al. |
| 2014/0348789 A1 | 11/2014 | Tavernier et al. |
| 2015/0139951 A1 | 5/2015 | Grewal et al. |
| 2015/0265721 A1* | 9/2015 | Lahoud ................ A61P 43/00 424/178.1 |

FOREIGN PATENT DOCUMENTS

| | | |
|---|---|---|
| EP | 1739090 A2 | 1/2007 |
| EP | 2343081 A1 | 7/2011 |
| WO | WO 9102754 A1 | 3/1991 |
| WO | WO 2003033720 A2 | 4/2003 |
| WO | WO 2006053883 A1 | 5/2006 |
| WO | WO 2006115800 A2 | 11/2006 |
| WO | WO 2006120580 A2 | 11/2006 |
| WO | WO 2007110231 A2 | 10/2007 |
| WO | WO 2008014612 A1 | 2/2008 |
| WO | WO 2008124086 A2 | 10/2008 |
| WO | WO 2009003145 A1 | 12/2008 |
| WO | WO 2009039409 A1 | 3/2009 |
| WO | WO 2010036918 A2 | 4/2010 |
| WO | WO 2010066740 A1 | 6/2010 |
| WO | WO 2011020783 A2 | 2/2011 |
| WO | WO 2011029870 A1 | 3/2011 |
| WO | WO 2012170072 A1 | 12/2012 |
| WO | WO 2013/059885 A2 | 5/2013 |
| WO | WO 2013059885 A2 | 5/2013 |
| WO | WO 2013107791 A1 | 7/2013 |
| WO | WO 2013134138 A1 | 9/2013 |
| WO | WO 2014164680 A1 | 10/2014 |
| WO | WO 2015007520 A1 | 1/2015 |

(Continued)

OTHER PUBLICATIONS

Bansal, et al., "Targeted Recombinant Fusion Proteins of IFN [gamma] and Mimetic IFN [gamma] with PDGF[beta] R Bicyclic Peptide Inhibits Liver Fibrogenesis in Vivo," PLOS One, vol. 9, No. 2, 10 pages, 2014.
Ebbinghaus, et al., "Engineered vascular-targeting antibody-interferon-gamma fusion protein for cancer therapy," Int. J. Cancer: vol. 116, No. 2, pp. 304-313, 2005.
Hemmerle, et al., "The Dose-Dependent Tumor Targeting of Antibody-IFN Fusion Proteins Reveals an Unexpected Receptor-Trapping Mechanism in Vivo," Cancer Immunology Research, vol. 2, No. 6, pp. 559-568, 2014.
International Search Report & Written Opinion, PCT Appl. No. PCT/EP2017/077193, dated 2018, 13 pages.
Acres, B., et al., "Fusokine Interleukin-2/Interleukin-18, a Novel Potent Innate and Adaptive Immune Stimulator with Decreased Toxicity", Cancer Res., vol. 65, No. 20, (2005), pp. 9536-9546.

(Continued)

*Primary Examiner* — Gary B Nickol
*Assistant Examiner* — Jegatheesan Seharaseyon
(74) *Attorney, Agent, or Firm* — Morgan, Lewis & Bockius LLP

(57) ABSTRACT

The present invention relates, in part, to chimeric proteins comprising mutant interferon-γ and their use as therapeutic agents.

29 Claims, 7 Drawing Sheets
Specification includes a Sequence Listing.

(56) References Cited

FOREIGN PATENT DOCUMENTS

| WO | WO 2015007536 A2 | 1/2015 |
|---|---|---|
| WO | WO 2015007542 A1 | 1/2015 |
| WO | WO 2015007903 A1 | 1/2015 |
| WO | WO 2017077382 A1 | 5/2017 |

OTHER PUBLICATIONS

Baba, M., et al., "Identification of CCR6, the Specific Receptor for a Novel Lymphocyte-Directed CC Chemokine LARC", The Journal of Biological Chemistry, vol. 272, No. 23, (1997), pp. 14893-14898.

Barbara, J A, et al., "Dissociation of TNF-alpha cytotoxic and proinflammatory activities by p55 receptor- and p75 receptor-selective TNF-alpha mutants," EMBO Journal, vol. 13, No. 4, (1994) pp. 843-850.

Bork, "Powers and Pitfalls in Sequence Analysis: The 70% Hurdle", Genome Research, vol. 10 (2000), pp. 398-400.

Bork, et al., "Go hunting in sequence databases but watch out for the traps." Trends in Genetics, vol. 12 (1996), pp. 425-427.

Boschert, et al., "Single chain TNF derivatives with individually mutated receptor binding sites reveal differential stoichiometry of ligand receptor complex formation for TNFR1 and TNFR2," Cellular Signalling 22 (7): 2010, pp. 1088-1096.

Bremer, et al., "Superior activity of fusion protein scFvRit:sFasL over cotreatment with rituximab and Fas agonists," Cancer Res. 68: 2008, pp. 597-604.

Camacho, N.P., et al., "Structure of an Interleukin-1β Mutant With Reduced Bioactivity Shows Multiple Subtle Changes in Conformation That Affect Protein-Protein Recognition", Biochemistry, vol. 32, No. 34, (1993), pp. 8749-8757.

Coulstock, E., et al., "Liver-Targeting of Interferon-Alpha with Tissue Specific Domain Antibodies." PLOE One, vol. 8, No. 2, (2013), pp. 1-11.

De Bruyn, M., et al., "Antibody-Based Fusion Proteins to Target Death Receptors in Cancer", Cancer Letters, vol. 332, (2013), pp. 175-183.

Deffar, et al., "Nanobodies—The New Concept in Antibody Engineering" African Journal of Biotechnology, 2009, vol. 8, No. 12, pp. 2645-2652.

Dijkmans, R., et al., "Murine Interferon-γ/Interleukin-1 Fusion Proteins Used as Antigens for the Generation of Hybridomas Producing Monoclonal Anti-Interleukin-1 Antibodies", Cytokine, vol. 3, No. 2, (1991), pp. 134-140.

Dimitrov, D. S., "Engineered CH2 Domains (Nanoantibodies)", mAbs, Landes Bioscience, vol. 1, No. 1, (2009), pp. 26-28.

Frey, K., et al., "Antibody-Based Targeting of Interferon-Alpha to the Tumor Neovasculature: A Critical Evaluation", Integrative Biology, vol. 3, (2011), pp. 468-478.

Garcin, et al., "High Efficiency cell-specific targeting of cytokine activity," Nature Communications, vol. 5, No. 8 (2014).

Garlanda, et al., "The Interleukin-1 Family: Back to the Future," Immunity, Dec. 12, 2013 39(6), pp. 1003-1018.

Holler, N., et al., "Two Adjacent Trimeric Fas Ligands are Required for Fas Signaling and Formation of a Death-Inducing Signaling Complex", Molecular and Cellular Biology, vol. 23, No. 4, (2003), pp. 1428-1440.

Huang, T., et al., "A Trimeric Anti-HER2/neu ScFv and Tumor Necrosis Factor-[alpha] Fusion Protein Induces HER2/ Neu Signaling and Facilitates Repair of Injured Epithelia", The Journal of Pharmacology and Experimental Therapeutics, vol. 316, No. 3, (2006), pp. 983-991.

International Search Report & Written Opinion, PCT Application No. PCT/EP17/61543, dated Jul. 11, 2017, 8 pages.

International Search Report & Written Opinion, PCT Application No. PCT/EP17/61544, dated Oct. 20, 2017, 21 pages.

Krippner-Heidenreich, A., et al., "Single-Chain TNF, a TNF Derivative with Enhanced Stability and Antitumoral Activity", The Journal of Immunology, vol. 180, (2008), pp. 8176-8183.

Loetscher, H, et al., "Human Tumor Necrosis Factor alpha (TNFalpha) Mutants with Exclusive Specificity for the 55-kDa or 75-kDa TNF Receptors," Journal of Biological Chemistry, American Society for Biochemistry and Molecular Biology, US, vol. 268, No. 35, (1993), pp. 26350-26357.

Masci, P., et al., "New and Modified Interferon alfas: Preclinical and Clinical Data", Current Oncology Reports, vol. 5, (2003), pp. 108-113.

Ngo, et al., "Computational Complexity, Protein Structure Prediction, and the Levinthal Paradox.The Protein Folding Problem and Tertiary Structure Prediction", Edited by: Mertz, et al., (Birkhauser, Boston), (1994), pp. 492-495.

Pan, M., et al., "Mutation of the IFNAR-1 Receptor Binding Site of Human IFN-[alpha]2 Generates Type I IFN Competitive Antagonists", Biochemistry, vol. 47, (2008), pp. 12018-12027.

Patris, et al., "Nanoimmunoassay onto a screen printed electrode for HER2 breast cancer biomarker determination", Talanta, 2014, vol. 130, pp. 164-170.

Penafuerie, C., et al., "The Human Ortholog of Granulocyte Macrophage Colony-Stimulating Factor and Interleukin-2 Fusion Protein Induces Potent Ex Vivo Natural Killer Cell Activation and Maturation", Cancer Res, vol. 69, No. 23, (2009), pp. 9020-9028.

Piehler, et al., "New Structural and Functional Aspects of the Type I Inteferon-Receptor Interaction Revealed by Comprehensive Mutational Analysis of the Binding Interface," Journal of Biological Chemistry, vol. 275, No. 51, Dec. 22, 2000, pp. 40425-40433.

Rafei, M., et al., "A MCP1 Fusokine with CCR2-Specific Tumoricidal Activity", Molecular Cancer, vol. 10, No. 121, (2011), pp. 1-11.

Rafei, M., et al., "An Engineered GM-CSF-CCL2 Fusokine Is a Potent Inhibitor of CCR2-Driven Inflammation as Demonstrated in a Murine Model of Inflammatory Arthritis", The Journal of Immunology, vol. 183, (2009), pp. 1759-1766.

Roisman, LC., et al., "Structure of the Interferon-Receptor Complex Determined by Distant Constraints from Double Mutant Cycles and Flexible Docking", PNAS, vol. 98, No. 23, (2001), pp. 13231-13236.

Rovero, S., et al., "Insertion of the DNA for the 163-171 Peptide of IL 1β Enables a DNA Vaccine Encoding p185neu to Inhibit Mammary Carcinogenesis in Her-2/neu Transgenic BALB/c Mice", Gene Therapy, vol. 8, (2001), pp. 447-452.

Runkel, et al., "Systematic Mutational Mapping of Sites on Human Interferon-β-1a That Are Important for Receptor Binding and Functional Activity," Biochemistry, vol. 39, No. 10, 2000, pp. 2538-2551.

Schutyser, E., et al., "The CC Chemokine CCL20 and its Receptor CCR6", Cytokine & Growth Factor Reviews, vol. 14, (2003), pp. 409-426.

Vaneycken, et al., "Preclinical Screening of Anti-HER2 Nanobodies for Molecular Imaging of Breast Cancer", The FASEB Journal, 2011, vol. 25, pp. 2433-2446.

Weber, H., et al., "Single Amino Acid Changes that Render Human IFN-[alpha]2 Biologically Active on Mouse Cells", The EMBO Journal, vol. 6, No. 3, (1987), pp. 591-598.

Wells, "Additivity of mutational effects in proteins." Biochemistry, vol. 29, No. 37, (1990), pp. 8509-8517.

Wesolowski, et al., "Single Domain Antibodies: Promising Experimental and Therapeutic Tools in Infection and Immunity", Med Microbiol Immunol. 2009, vol. 198, pp. 157-174.

* cited by examiner

FIG. 1

```
                        AFN gamma mutations
                                GG****        (P-669)
                                G*****        (P-668)
                                *A********        (P-667)
         10          20          30          40
    QDPYVKEAEN  LKKYFNAGHS  DVADNGTLFL  GILKNWKEES
         50          60          70          80
    DRKIMQSQIV  SFYFKLFKNF  KDDQSIQKSV  ETIKEDMNVK

*A*G**    (P-676)
                                            *******G**    (P-675)
                                            ****A*****    (P-674)
                                            *A****    (P-673)
                                            D*********    (P-672)
                                            A*********    (P-671)
         90         100         110         120
    FFNSNKKKRD  DFEKLTNYSV  TDLNVQRKAI  HELIQVMAEL
        130         140
    SPAAKTGKRK  RSQMLFRGRR  ASQ: full length         (P-522)
    SPAAKTGKRK  RSQMLFRG: c5                         (P-662)
    SPAAKTGKRK  RSQMLF: c7                           (P-663)
    SPAAKTGKR: c14                                   (P-664)
    SPAAKTGK: c15                                    (P-665)
    SPAAKTG: c16                                     (P-666)
```

TARGETED MUTANT INTERFERON-GAMMA AND USES THEREOF

CROSS-REFERENCE TO RELATED APPLICATION

This application is a 371 national stage entry of PCT/EP2017/077193, filed Oct. 24, 2017, which claims the benefit of U.S. Provisional Application No. 62/411,823, filed Oct. 24, 2016, the contents of both of which are incorporated herein by reference in their entirety.

FIELD

The present invention relates, in part, to chimeric proteins comprising mutant interferon-γ and their use as therapeutic agents.

SEQUENCE LISTING

The instant application contains a Sequence Listing which has been submitted in ASCII format via EFS-Web and is hereby incorporated by reference in its entirety. Said ASCII copy, created about Oct. 21, 2017, is 766 KB in size and is named ORN-022PC_ST25.txt.

BACKGROUND

Interferons (IFNs) are a family of proteins synthesized in mammalian cells in response to stimulation by viruses, mitogens, and other substances. Interferons have been shown to have antiviral, antiproliferative, and immunomodulatory activities. More than twenty distinct interferons have been identified humans, and they are classified into type I, type II, and type III interferons.

Among the various interferons, interferon-gamma (IFN-γ) is the only member of the type II class of interferons. IFN-γ has a lower specific antiviral activity than type I interferons such as interferon-α and interferon-β, but presents more immunomodulatory properties than type I interferons. IFN-γ exerts its biological effects through specific interactions with the IFN-γ receptor, which is a complex of the IFN-γ receptor 1 and IFN-γ receptor 2 subunits. IFN-γ binds to the IFN-γ receptor as a dimer and upon binding activates the JAK-STAT pathway.

Pharmaceutical compositions comprising recombinant human wild type IFN-γ have been developed (e.g., ACTIMMUNE). However, administration of recombinant human IFN-γ involves frequent injections due to short plasma half-life. Additionally use of recombinant human IFN-γ have been associated with side effects including fever, chills, sweating, headache, myalgia, drowsiness, pain, erythema, elevation of liver enzymes, reversible granulo- and thrombopenia and cardiotoxicity.

Accordingly, there remains a need for improved IFN-γ compositions for treating diseases and disorders while causing minimal toxicity and side effects.

SUMMARY

In some aspects, the present invention relates to chimeric proteins comprising a modified interferon-gamma (IFN-γ) as a signaling agent. In an embodiment, the IFN-γ is a human IFN-γ. In various embodiments, the modified IFN-γ comprises one or more mutations that reduce its biological activity. In various embodiments, the modified IFN-γ comprises one or more mutations that reduce its affinity and/or biological activity for a therapeutic receptor. In an embodiment, the therapeutic receptor is the IFN-γ receptor, which is composed of the IFN-γ receptor 1 and IFN-γ receptor 2 subunits. In an embodiment, the modified IFN-γ comprises one or more mutations that reduce its affinity and/or biological activity for the IFN-γ receptor 1 subunit. In another embodiment, the modified IFN-γ comprises one or more mutations that reduce the activity of the IFN-γ receptor 2 subunit. In an embodiment, the modified IFN-γ comprises one or more mutations that reduce its affinity and/or biological activity for the IFN-γ receptor 1 subunit and comprises one or more mutations that reduce the activity of the IFN-γ receptor 2 subunit. In various embodiments, the mutations may be amino acid substitutions or protein truncations. In some embodiments, the mutations may involve the formation of a single chain IFN-γ.

In some embodiments, the chimeric protein comprises one or more additional signaling agents, e.g., without limitation, an interferon, an interleukin, and a tumor necrosis factor, that may be modified. In various embodiments, the chimeric protein of the invention provides improved safety compared to an unmodified, wild type IFN-γ.

In various embodiments, the chimeric protein comprises one or more targeting moieties which have recognition domains (e.g., antigen recognition domains, including without limitation various antibody formats, inclusive of single-domain antibodies) which specifically bind to a target (e.g., antigen, receptor) of interest. In various embodiments, the targeting moieties have recognition domains that specifically bind to a target (e.g., antigen, receptor) of interest, including those found on one or more immune cells, which can include, without limitation, T cells, cytotoxic T lymphocytes, T helper cells, natural killer (NK) cells, natural killer T (NKT) cells, anti-tumor macrophages (e.g., M1 macrophages), B cells, and dendritic cells. In some embodiments, the recognition domains specifically bind to a target (e.g., antigen, receptor) of interest and effectively recruit one of more immune cells. In some embodiments, the targets (e.g., antigens, receptors) of interest can be found on one or more tumor cells. In some embodiments, the present chimeric proteins may recruit an immune cell, e.g., an immune cell that can kill and/or suppress a tumor cell, to a site of action (such as, by way of non-limiting example, the tumor microenvironment). In some embodiments, the recognition domains specifically bind to a target (e.g., antigen, receptor) of interest which is part of a non-cellular structure.

In various embodiments, the present chimeric proteins find use in the treatment of various diseases or disorders such as cancer, infections, immune disorders, autoimmune diseases, cardiovascular diseases, wound healing, ischemia-related diseases, neurodegenerative diseases, metabolic diseases, and many other diseases and disorders, and the present invention encompasses various methods of treatment.

Any aspect or embodiment disclosed herein can be combined with any other aspect or embodiment as disclosed herein.

BRIEF DESCRIPTION OF THE FIGURES

Having thus described the presently disclosed subject matter in general terms, reference will now be made to the accompanying Figures, which are not necessarily drawn to scale, and wherein:

FIG. 1 shows aligned sequences for the wild type IFN-γ and lacking the N-terminal signal sequences (P-522; SEQ ID NO: 947) and modified IFN-γ (P-662 to P-676, respectively, SEQ ID NO: 948 to SEQ ID NO: 962).

Figure 2A:
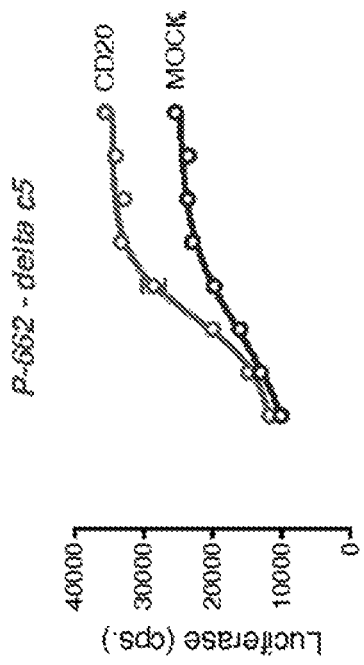
Figure 2B:
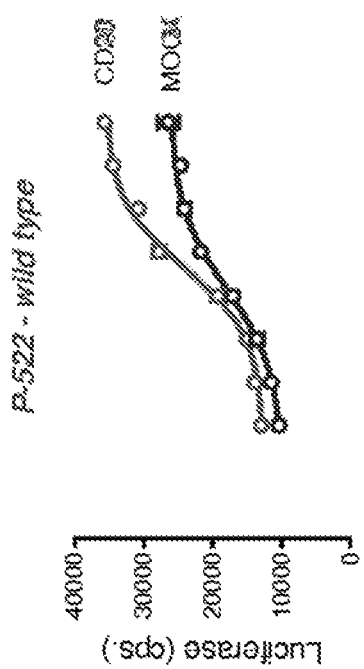
Figure 2C:
Figure 2D:
Figure 2F:
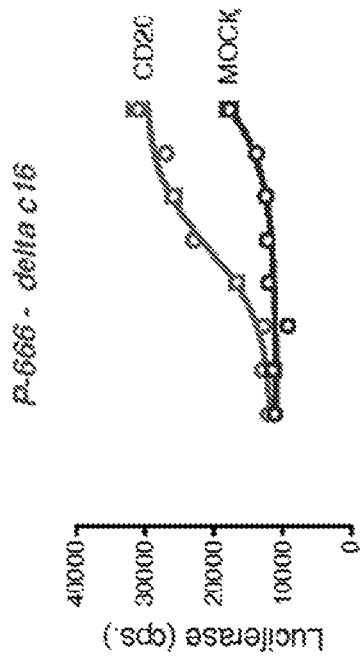
Figure 2E:
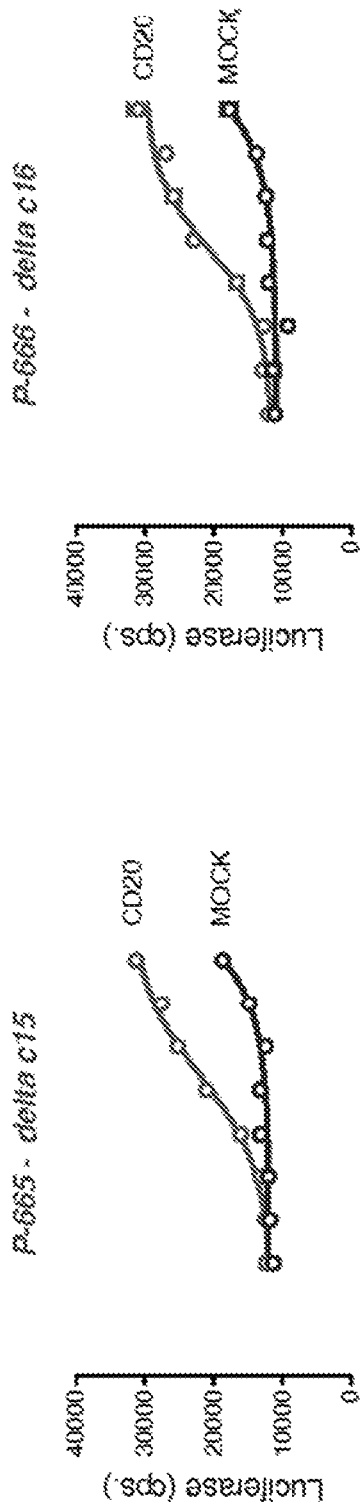
Figure 2H:
Figure 2G:
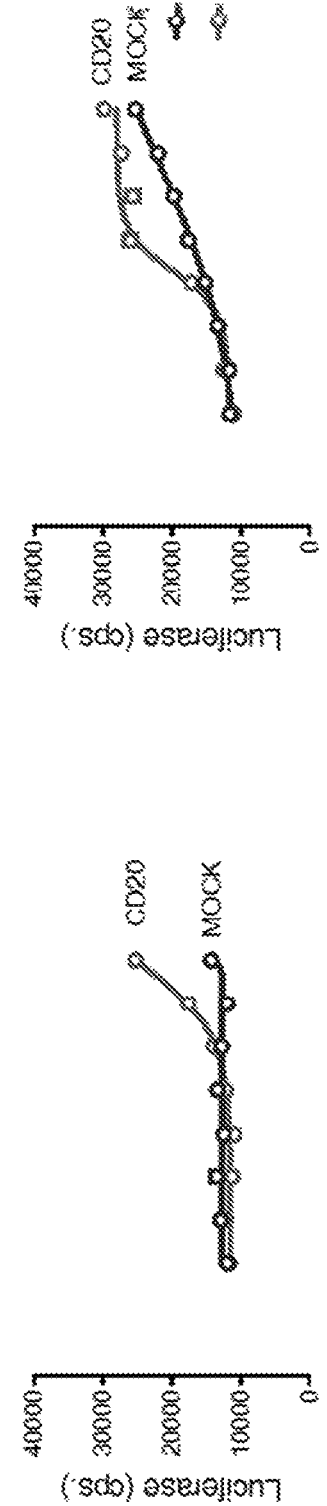
Figure 2J:
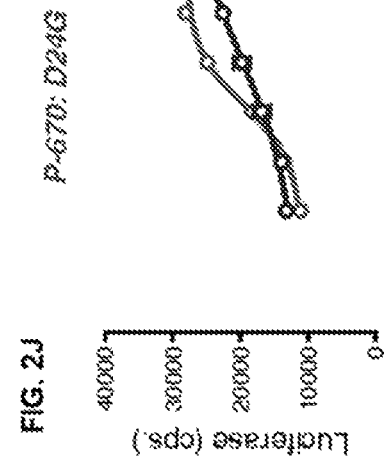
Figure 2L:
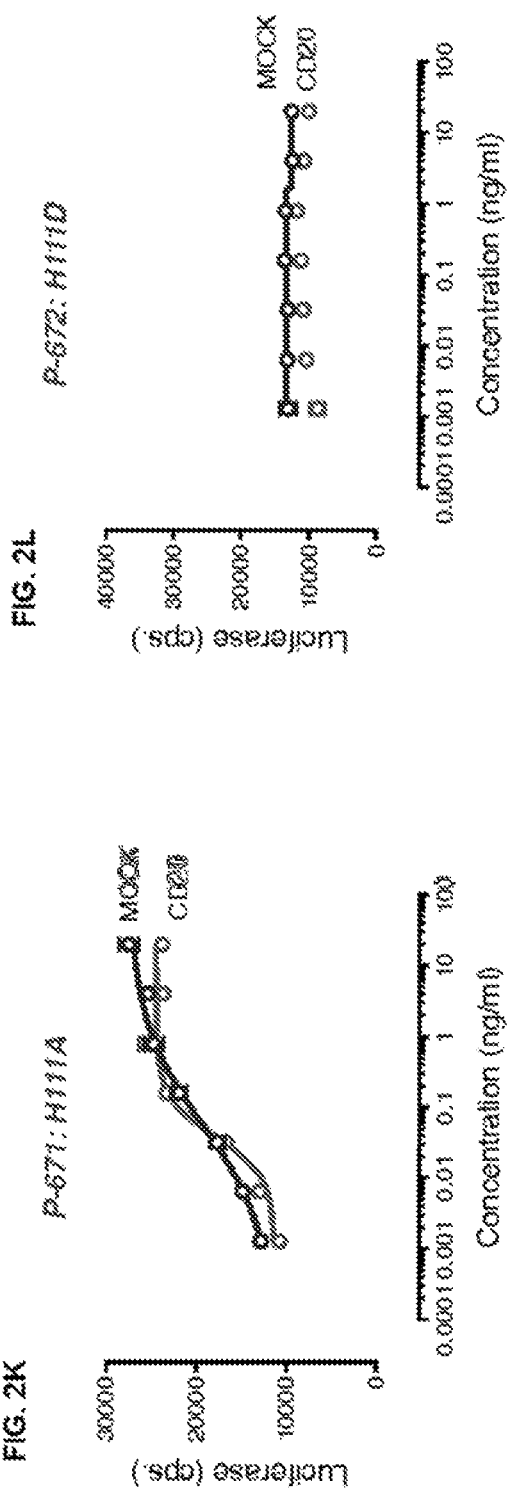
Figure 2I:
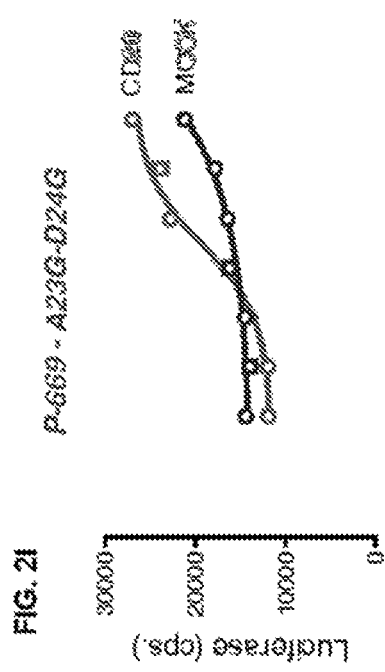
Figure 2K:
Figure 2M:
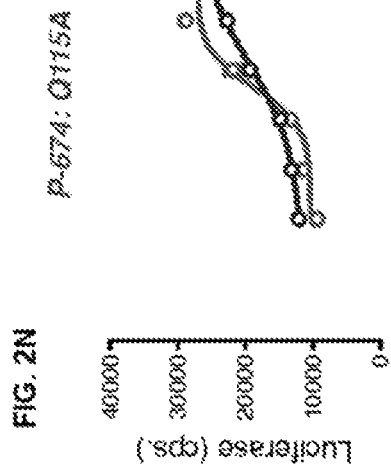
Figure 2O:
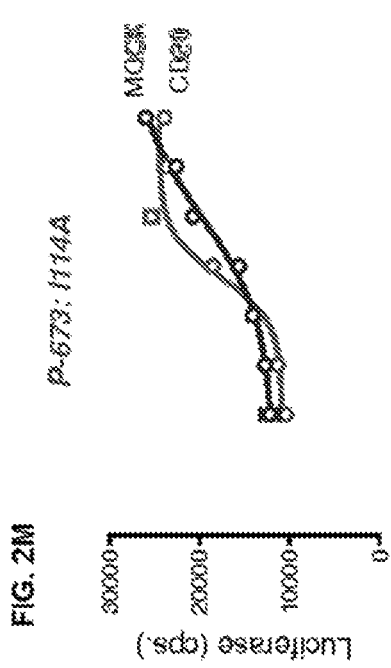
Figure 2N:
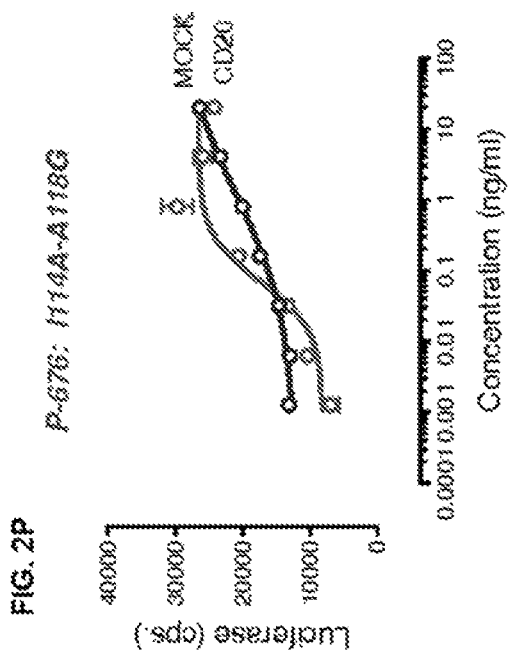
Figure 2P:
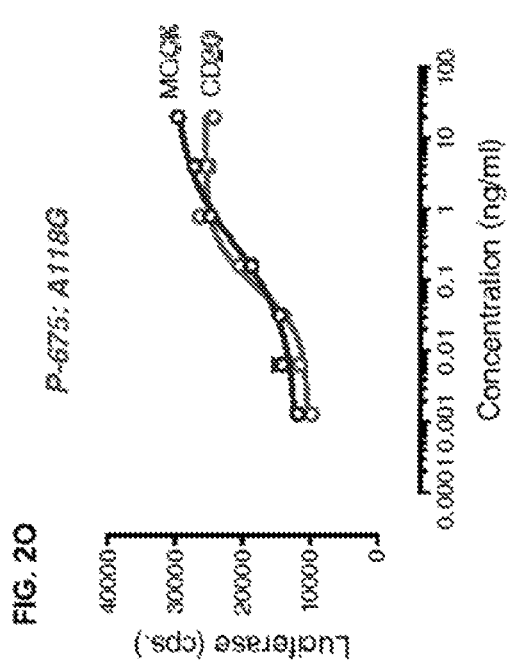

FIG. 2A to FIG. 2P are graphs showing pGAS reporter activity in cells transfected with a CD20 plasmid or an empty vector and stimulated with chimeric proteins of the present invention. Data is shown as means±s.d.

FIG. 3A to FIG. 3H are graphs showing immunofluorescence intensities for cells transfected with a CD20 plasmid or an empty vector and stimulated with chimeric proteins of the present invention. Cells were probed with a phospho-STAT1 antibody. Data is shown as means±STDEV.

DETAILED DESCRIPTION

The present invention is based, in part, on the surprising discovery that targeted chimeric proteins that include a modified IFN-γ with reduced affinity and/or biological activity for one or more receptors exhibit beneficial therapeutic properties and reduced side effects. The present invention provides pharmaceutical compositions comprising the chimeric proteins and their use in the treatment of various diseases. Administration of the chimeric proteins and pharmaceutical compositions of the invention achieves significantly reduced side effects.

Modified Interferon-Gamma

In one aspect, the present invention provides a chimeric protein that includes a signaling agent which is a modified version of an interferon-gamma (IFN-γ) with reduced affinity and/or biological activity for one or more receptors. Interferons (IFNs) are a well-known family of cytokines secreted by a large variety of eukaryotic cells. Interferons have a variety of biological activities, including anti-viral, immunomodulatory, immunoregulatory, and anti-proliferative properties, and have been utilized as therapeutic agents for treatment of various diseases.

Among the various interferons, IFN-γ is the only member of the type II class of interferons. IFN-γ is produced predominantly by natural killer (NK) and natural killer T (NKT) cells as part of the innate immune response. IFN-γ is also produced by CD4 Th1 and CD8 cytotoxic T lymphocyte (CTL) effector T cells, macrophages, dendritic cells, and B cells. Activated IFN-γ forms a dimer which acts through a heterodimeric receptor (i.e., IFN-γ receptor or IFN-γR) composed of IFN-γ receptor 1 and IFN-γ receptor 2 subunits. IFN-γ receptor 1 is the major ligand-binding subunit, while IFN-γ receptor 2 is necessary for signal transduction and also increases the affinity of IFN-γ receptor 1 for its ligand. Binding of the IFN-γ dimer to the receptor activates the JAK-STAT signaling pathway to elicit various biological effects.

In various embodiments, the chimeric protein of the invention comprises a modified version of IFN-γ as a signaling agent. In various embodiments, the IFN-γ encompasses functional derivatives, analogs, precursors, isoforms, splice variants, or fragments of IFN-γ. In various embodiments, the IFN-γ encompasses IFN-γ derived from any species. In an embodiment, the chimeric protein comprises a modified version of mouse IFN-γ. In another embodiment, the chimeric protein comprises a modified version of human IFN-γ.

Human IFN-γ is a polypeptide comprising 166 amino acid residues. In an embodiment, the human IFN-γ has the amino acid sequence of SEQ ID NO: 946, in which the signal peptide comprises the first 23 amino acids.

As used herein, human IFN-γ may also refer to mature human IFN-γ without the N-terminal signal peptide. In this embodiment, the mature human IFN-γ comprises 143 amino acids and has the amino acid sequence of SEQ ID NO: 947.

In some embodiments, the human IFN-γ is a glycosylated form of human IFN-γ. In some embodiments, the human IFN-γ is a non-glycosylated form of human IFN-γ.

The sequences of IFN-γ are known in the art. In various embodiments the modified IFN-γ comprises an amino acid sequence that has at least about 60%, or at least about 61%, or at least about 62%, or at least about 63%, or at least about 64%, or at least about 65%, or at least about 66%, or at least about 67%, or at least about 68%, or at least about 69%, or at least about 70%, or at least about 71%, or at least about 72%, or at least about 73%, or at least about 74%, or at least about 75%, or at least about 76%, or at least about 77%, or at least about 78%, or at least about 79%, or at least about 80%, or at least about 81%, or at least about 82%, or at least about 83%, or at least about 84%, or at least about 85%, or at least about 86%, or at least about 87%, or at least about 88%, or at least about 89%, or at least about 90%, or at least about 91%, or at least about 92%, or at least about 93%, or at least about 94%, or at least about 95%, or at least about 96%, or at least about 97%, or at least about 98%, or at least about 99% sequence identity with the known wild type amino acid sequences of IFN-γ (e.g., about 60%, or about 61%, or about 62%, or about 63%, or about 64%, or about 65%, or about 66%, or about 67%, or about 68%, or about 69%, or about 70%, or about 71%, or about 72%, or about 73%, or about 74%, or about 75%, or about 76%, or about 77%, or about 78%, or about 79%, or about 80%, or about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, or about 99% sequence identity).

In some embodiments the modified IFN-γ comprises an amino acid sequence that has at least about 60%, or at least about 61%, or at least about 62%, or at least about 63%, or at least about 64%, or at least about 65%, or at least about 66%, or at least about 67%, or at least about 68%, or at least about 69%, or at least about 70%, or at least about 71%, or at least about 72%, or at least about 73%, or at least about 74%, or at least about 75%, or at least about 76%, or at least about 77%, or at least about 78%, or at least about 79%, or at least about 80%, or at least about 81%, or at least about 82%, or at least about 83%, or at least about 84%, or at least about 85%, or at least about 86%, or at least about 87%, or at least about 88%, or at least about 89%, or at least about 90%, or at least about 91%, or at least about 92%, or at least about 93%, or at least about 94%, or at least about 95%, or at least about 96%, or at least about 97%, or at least about 98%, or at least about 99% sequence identity with human IFN-γ having an amino acid sequence of SEQ ID NO:946 (e.g., about 60%, or about 61%, or about 62%, or about 63%, or about 64%, or about 65%, or about 66%, or about 67%, or about 68%, or about 69%, or about 70%, or about 71%, or about 72%, or about 73%, or about 74%, or about 75%, or about 76%, or about 77%, or about 78%, or about 79%, or about 80%, or about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, or about 99% sequence identity).

In some embodiments the modified IFN-γ comprises an amino acid sequence that has at least about 60%, or at least about 61%, or at least about 62%, or at least about 63%, or at least about 64%, or at least about 65%, or at least about 66%, or at least about 67%, or at least about 68%, or at least about 69%, or at least about 70%, or at least about 71%, or at least about 72%, or at least about 73%, or at least about 74%, or at least about 75%, or at least about 76%, or at least about 77%, or at least about 78%, or at least about 79%, or at least about 80%, or at least about 81%, or at least about 82%, or at least about 83%, or at least about 84%, or at least about 85%, or at least about 86%, or at least about 87%, or at least about 88%, or at least about 89%, or at least about 90%, or at least about 91%, or at least about 92%, or at least about 93%, or at least about 94%, or at least about 95%, or at least about 96%, or at least about 97%, or at least about 98%, or at least about 99% sequence identity with human IFN-γ having an amino acid sequence of SEQ ID NO:947 (e.g., about 60%, or about 61%, or about 62%, or about 63%, or about 64%, or about 65%, or about 66%, or about 67%, or about 68%, or about 69%, or about 70%, or about 71%, or about 72%, or about 73%, or about 74%, or about 75%, or about 76%, or about 77%, or about 78%, or about 79%, or about 80%, or about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, or about 99% sequence identity).

In various embodiments, the modified IFN-γ comprises an amino acid sequence having one or more amino acid mutations. In some embodiments, the one or more amino acid mutations may be independently selected from substitutions, insertions, deletions, and truncations.

In some embodiments, the amino acid mutations are amino acid substitutions, and may include conservative and/or non-conservative substitutions.

"Conservative substitutions" may be made, for instance, on the basis of similarity in polarity, charge, size, solubility, hydrophobicity, hydrophilicity, and/or the amphipathic nature of the amino acid residues involved. The 20 naturally occurring amino acids can be grouped into the following six standard amino acid groups: (1) hydrophobic: Met, Ala, Val, Leu, Ile; (2) neutral hydrophilic: Cys, Ser, Thr; Asn, Gln; (3) acidic: Asp, Glu; (4) basic: His, Lys, Arg; (5) residues that influence chain orientation: Gly, Pro; and (6) aromatic: Trp, Tyr, Phe.

As used herein, "conservative substitutions" are defined as exchanges of an amino acid by another amino acid listed within the same group of the six standard amino acid groups shown above. For example, the exchange of Asp by Glu retains one negative charge in the so modified polypeptide. In addition, glycine and proline may be substituted for one another based on their ability to disrupt α-helices.

As used herein, "non-conservative substitutions" are defined as exchanges of an amino acid by another amino acid listed in a different group of the six standard amino acid groups (1) to (6) shown above.

In various embodiments, the substitutions may also include non-classical amino acids (e.g., selenocysteine, pyrolysine, N-formylmethionine β-alanine, GABA and δ-Aminolevulinic acid, 4-aminobenzoic acid (PABA), D-isomers of the common amino acids, 2,4-diaminobutyric acid, α-amino isobutyric acid, 4-aminobutyric acid, Abu, 2-amino butyric acid, γ-Abu, ε-Ahx, 6-amino hexanoic acid, Aib, 2-amino isobutyric acid, 3-amino propionic acid, ornithine, norleucine, norvaline, hydroxyproline, sarcosme, citrulline, homocitrulline, cysteic acid, t-butylglycine, t-butylalanine, phenylglycine, cyclohexylalanine, β-alanine, fluoro-amino acids, designer amino acids such as β methyl amino acids, C α-methyl amino acids, N α-methyl amino acids, and amino acid analogs in general).

In various embodiments, the IFN-γ is modified to have one or more mutations. In some embodiments, the mutations allow for the modified IFN-γ to have one or more of attenuated activity such as one or more of reduced binding affinity, reduced endogenous activity, and reduced specific bioactivity relative to unmutated, e.g., the wild type form of IFN-γ. For instance, the one or more of attenuated activity such as reduced binding affinity, reduced endogenous activity, and reduced specific bioactivity relative to unmutated, e.g., the wild type form of IFN-γ may be at a therapeutic receptor such as the IFN-γ receptor. Consequentially, in various embodiments, the mutations allow for the modified soluble agent to have reduced systemic toxicity, reduced side effects, and reduced off-target effects relative to unmutated, e.g., the wild type form of IFN-γ.

In various embodiments, the IFN-γ is modified to have a mutation that reduces its binding affinity and/or activity at a therapeutic receptor such as the IFN-γ receptor comprising the IFN-γ receptor 1 and IFN-γ receptor 2 subunits. In some embodiments, the activity provided by the wild type IFN-γ is agonism at the therapeutic receptor (e.g., activation of a cellular effect at a site of therapy). For example, the wild type IFN-γ may activate the therapeutic receptor. In such embodiments, the mutation results in the modified IFN-γ to have reduced activating activity at the therapeutic receptor.

In some embodiments, the reduced affinity and/or activity at the therapeutic receptor (e.g., IFN-γ receptor) is restorable by attachment with a targeting moiety. In other embodiments, the reduced affinity and/or activity at the therapeutic receptor is not substantially restorable by attachment with the targeting moiety. In various embodiments, the therapeutic chimeric proteins of the present invention reduce off-target effects because the IFN-γ has mutations that weaken binding affinity and/or activity at a therapeutic receptor. In various embodiments, this reduces side effects observed with, for example, the wild type IFN-γ. In various embodiments, the modified IFN-γ is substantially inactive en route to the site of therapeutic activity and has its effect substantially on specifically targeted cell types which greatly reduces undesired side effects.

In various embodiments, the modified IFN-γ has one or more mutations that cause the IFN-γ to have attenuated or reduced affinity and/or activity, e.g., binding (e.g., $K_D$) and/or activation (measurable as, for example, $K_A$ and/or $EC_{50}$) for one or more therapeutic receptors (e.g., IFN-γ receptor). In various embodiments, the reduced affinity and/or activity at the therapeutic receptor allows for attenuation of activity and/or signaling from the therapeutic receptor.

In various embodiments, the modified IFN-γ has one or more mutations that reduce its binding to or its affinity for and/or biological activity for the IFN-γ receptor 1 subunit. In one embodiment, the modified IFN-γ has reduced affinity and/or activity at the IFN-γ receptor 1 subunit. In various embodiments, the modified IFN-γ is human IFN-γ that has one or more mutations at amino acid residues involved with binding to the IFN-γ receptor 1 subunit. In some embodiments, the modified IFN-γ is human IFN-γ that has one or more mutations at amino acids located at the interface with the IFN-γ receptor 1 subunit. In various embodiments, the one or more mutations are at amino acids selected from, but not limited to Q1, V5, E9, K12, H19, S20, V22, A23, D24, N25, G26, T27, L30, K108, H111, E112, I114, Q115, A118, E119, and K125 (each with respect SEQ ID NO: 947, which is a wild type human IFN-γ and which lacks its N-terminal signal sequence). In some embodiments, the one or more mutations are substitutions selected from V5E, S20E, V22A, A23G, A23F, D24G, G26Q, H111A, H111D, I114A, Q115A, and A118G (each with respect SEQ ID NO: 947). In embodiments, the one or more mutations are substitutions selected from V22A, A23G, D24G, H111A, H111D, I114A, Q115A, and A118G; these modified IFN-γs have an amino acid sequence, respectively, of SEQ ID NO: 953, SEQ ID NO: 954, and SEQ ID NO: 956 to SEQ ID NO: 961).

In an embodiment, the modified IFN-γ comprises the mutations A23G and D24G, this modified IFN-γ has an amino acid sequence of SEQ ID NO: 955. In another embodiment, the modified IFN-γ comprises the mutations I114A and A118G, this modified IFN-γ has an amino acid sequence of SEQ ID NO: 962. In a further embodiment, the modified IFN-γ comprises the mutations V5E, S20E, A23F, and G26Q.

In various embodiments, the modified IFN-γ has one or more of the following mutations: deletion of residue A23, deletion of residue D24, an S20I substitution, an A23V substitution, a D21K substitution and a D24A substitution.

In some embodiments, the modified IFN-γ has one or more mutations that reduce its binding to or its affinity and/or biological activity for the IFN-γ receptor 2 subunit.

In some embodiments, the modified IFN-γ has one or more mutations that reduce its binding to or its affinity and/or biological activity for both IFN-γ receptor 1 and IFN-γ receptor 2 subunits.

In some embodiments, the modified IFN-γ has one or more mutations that reduce its binding to or its affinity and/or biological activity for IFN-γ receptor 1 and one or more mutations that substantially reduce or ablate binding to or its affinity and/or biological activity for IFN-γ receptor 2. In some embodiments, chimeric proteins with such modified IFN-γ can provide target-selective IFN-γ receptor 1 activity (e.g., IFN-γ receptor 1 activity is restorable via targeting through the targeting moiety).

In some embodiments, the modified IFN-γ has one or more mutations that reduce its binding to or its affinity and/or biological activity for IFN-γ receptor 1 and one or more mutations that reduce its binding to or its affinity and/or biological activity for IFN-γ receptor 1. In some embodiments, chimeric proteins with such modified IFN-γ can provide target-selective IFN-γ receptor 1 and/or IFN-γ receptor 1 activity (e.g., IFN-γ receptor 1 and IFN-γ receptor 2 activities are restorable via targeting through the targeting moiety).

In various embodiments, the modified IFN-γ is truncated at the C-terminus. In some embodiments, the modified IFN-γ is mature IFN-γ comprising the amino acid sequence of SEQ ID NO: 947 with deletions of the C-terminal terminus. In such embodiments, the mature IFN-γ may comprise a C-terminal truncation of at least about 1, about 2, about 3, about 4, about 5, about 6, about 7, about 8, about 9, about 10, about 11, about 12, about 13, about 14, about 15, about 16, about 17, about 18, about 19, about 20, about 21, about 22, about 23, about 24, or about 25 amino acid residues. In an embodiment, the modified IFN-γ is mature IFN-γ comprising the amino acid sequence of SEQ ID NO:947 with C-terminal deletions of 5 amino acids, this modified IFN-γ has an amino acid sequence of SEQ ID NO: 948. In an embodiment, the modified IFN-γ is mature IFN-γ comprising the amino acid sequence of SEQ ID NO: 947 with C-terminal deletions of 7 amino acids, this modified IFN-γ has an amino acid sequence of SEQ ID NO: 949. In an embodiment, the modified IFN-γ is mature IFN-γ comprising the amino acid sequence of SEQ ID NO: 947 with C-terminal deletions of 14 amino acids, this modified IFN-γ has an amino acid sequence of SEQ ID NO: 950. In an embodiment, the modified IFN-γ is mature IFN-γ comprising the amino acid sequence of SEQ ID NO: 947 with C-terminal deletions of 15 amino acids, this modified IFN-γ has an amino acid sequence of SEQ ID NO: 951. In an embodiment, the modified IFN-γ is mature IFN-γ comprising the amino acid sequence of SEQ ID NO: 947 with C-terminal deletions of 16 amino acids, this modified IFN-γ has an amino acid sequence of SEQ ID NO: 952. Additional modified IFN-γ with C-terminal truncations that may be utilized in the present invention is described in Haelewyn et al., Biochem. J. (1997), 324:591-595 and Lundell et al., Protein Eng. (1991) 4:335-341, the entire contents are hereby incorporated by reference In various embodiments, the modified IFN-γ is a single chain IFN-γ as described, for example, in Randal et al. (2001) Structure 9:155-163 and Randal et al. (1998) Protein Sci. 7:1057-1060, the entire contents are hereby incorporated by reference. In some embodiments, the single chain IFN-γ comprises a first IFN-γ chain linked at its C-terminus to the N-terminus of a second IFN-γ chain. In various embodiments, the first and second IFN-γ chains are linked by a linker, as described elsewhere herein.

In some embodiments, the first IFN-γ chain comprises a C-terminal truncation of at least about 1, about 2, about 3, about 4, about 5, about 6, about 7, about 8, about 9, about 10, about 11, about 12, about 13, about 14, about 15, about 16, about 17, about 18, about 19, about 20, about 21, about 22, about 23, about 24, or about 25 amino acid residues. In an embodiment, the first IFN-γ chain comprises a C-terminal truncation of about 24 amino acid residues. In some embodiments, the second IFN-γ chain comprises an N-terminal truncation of at least about 1, about 2, about 3, about 4, or about 5 amino acid residues. In an embodiment, the second IFN-γ chain comprises an N-terminal truncation of about 3 amino acid residues. In some embodiments, the second IFN-γ chain comprises a C-terminal truncation of at least about 1, about 2, about 3, about 4, about 5, about 6, about 7, about 8, about 9, about 10, about 11, about 12, about 13, about 14, about 15, about 16, about 17, about 18, about 19, about 20, about 21, about 22, about 23, about 24, or about 25 amino acid residues. In various embodiments, the first and/or second IFN-γ chains comprise one or more amino acid mutations at Q1, V5, E9, K12, H19, S20, V22, A23, D24, N25, G26, T27, L30, K108, H111, E112, I114, Q115, A118, E119, and K125, as described elsewhere herein. In various embodiments, the first and/or second IFN-γ chains comprise one or more substitutions selected from V5E, S20E, V22A, A23G, A23F, D24G, G26Q, H111A, H111D, I114A, Q115A, and A118G. In various embodiments, the first and/or second IFN-γ chains comprise one or more substitutions selected from V22A, A23G, D24G, H111A, H111D, I114A, Q115A, and A118G. In various embodiments, the first and/or second IFN-γ chains comprise the A23G and the D24G substitution.

In various embodiments, the first and/or second IFN-γ chains comprise the I114A and the A118G substitution. In another embodiment, the mutations are V5E, S20E, A23F, and G26Q.

In various embodiments, a first and/or second IFN-γ chain comprises one or more substitutions as disclosed herein and the first and/or second IFN-γ chain comprises a C-terminal truncation as disclosed herein.

In various embodiments, a first and/or second IFN-γ chain comprises one or more substitutions as disclosed herein and a C-terminal truncation as disclosed herein.

The crystal structure of human IFN-γ is known and is described in, for example, Ealick et al., (1991) Science, 252: 698-702. Specifically, the structure of human IFN-γ has been shown to include a core of six α-helices and an extended unfolded sequence in the C-terminal region. In various embodiments, the modified IFN-γ has one or more mutations in the one or more helices which reduce its binding affinity and/or biological activity at a therapeutic receptor (e.g., IFN-γ receptor).

In various embodiments, the modified IFN-γ has about 1%, or about 3%, about 5%, about 10%, about 15%, about 20%, about 25%, about 30%, about 35%, about 40%, about 45%, about 50%, about 60%, about 65%, about 70%, about 75%, about 80%, about 85%, about 90%, about 95%, or about 10%-20%, about 20%-40%, about 50%, about 40%-60%, about 60%-80%, about 80%-100% of the affinity and/or biological activity for the therapeutic receptor (e.g., IFN-γ receptor or any one of its IFN-γ receptor 1 and IFN-γ receptor 2 subunits) relative to the wild type IFN-γ. In some embodiments, the binding affinity and/or biological activity is at least about 2-fold lower, about 3-fold lower, about 4-fold lower, about 5-fold lower, about 6-fold lower, about 7-fold lower, about 8-fold lower, about 9-fold lower, at least about 10-fold lower, at least about 15-fold lower, at least about 20-fold lower, at least about 25-fold lower, at least about 30-fold lower, at least about 35-fold lower, at least about 40-fold lower, at least about 45-fold lower, at least about 50-fold lower, at least about 100-fold lower, at least about 150-fold lower, or about 10-50-fold lower, about 50-100-fold lower, about 100-150-fold lower, about 150-200-fold lower, or more than 200-fold lower relative to the wild type IFN-γ.

In various embodiments, the modified IFN-γ comprises one or more mutations that reduce the endogenous activity of the IFN-γ to about 75%, or about 70%, or about 60%, or about 50%, or about 40%, or about 30%, or about 25%, or about 20%, or about 10%, or about 5%, or about 3%, or about 1%, e.g., relative to the wild type IFN-γ.

In some embodiments, the modified IFN-γ comprises one or more mutations that cause the modified IFN-γ to have reduced affinity and/or biological activity for a receptor. In some embodiments, the modified IFN-γ's binding affinity and/or biological activity for a receptor is lower than the binding affinity and/or biological activity of the targeting moiety for its receptor. In some embodiments, this binding affinity and/or biological activity differential is between the modified IFN-γ/receptor and targeting moiety/receptor on the same cell. In some embodiments, this binding affinity and/or biological activity, differential allows for the modified IFN-γ to have localized, on-target effects and to minimize off-target effects that underlie side effects that are observed with wild type IFN-γ. In some embodiments, this binding affinity and/or biological activity is at least about 2-fold, or at least about 5-fold, or at least about 10-fold, or at least about 15-fold lower, or at least about 25-fold, or at least about 50-fold lower, or at least about 100-fold, or at least about 150-fold less.

Receptor binding activity may be measured using methods known in the art. For example, affinity and/or binding activity may be assessed by Scatchard plot analysis and computer-fitting of binding data (e.g., Scatchard, 1949) or by reflectometric interference spectroscopy under flow through conditions, as described by Brecht et al. (1993), the entire contents of all of which are hereby incorporated by reference.

In various embodiments, the attenuated activity at the therapeutic receptor, the weakened affinity and/or biological activity at the therapeutic receptor is restorable by attachment with a targeting moiety, having high affinity for an antigen at the site of therapeutic activity (e.g., an antibody or antibody format described herein). The targeting is realized by linking the modified IFN-γ to a targeting moiety. In an embodiment, the modified IFN-γ is linked to a targeting moiety through its amino-terminus. In another embodiment, the modified IFN-γ is linked to a targeting moiety through its carboxy-terminus. In this way, the present chimeric proteins provide, in some embodiments, localized, on-target, and controlled therapeutic action at the therapeutic receptor In various embodiments, a chimeric protein of the present invention comprises an IFN-γ comprising one or more substitutions as disclosed herein and/or a C-terminal truncation as disclosed herein.

Therapeutic Agents Comprising the Present Modified Interferon-γ

Targeting Moiety Cellular Recruitment

In various embodiments, the chimeric proteins of the present invention additionally comprise one or more targeting moieties having recognition domains which specifically bind to a target (e.g., antigen, receptor) of interest. In exemplary embodiments, the chimeric protein may comprise two, three, four, five, six, seven, eight, nine, ten or more targeting moieties. In various embodiments, the target (e.g., antigen, receptor) of interest can be found on one or more immune cells, which can include, without limitation, T cells, cytotoxic T lymphocytes, T helper cells, natural killer (NK) cells, natural killer T (NKT) cells, anti-tumor macrophages (e.g., M1 macrophages), B cells, dendritic cells, or subsets thereof. In some embodiments, the recognition domains specifically bind to a target (e.g., antigen, receptor) of interest and effectively, directly or indirectly, recruit one of more immune cells. In some embodiments, the target (e.g., antigen, receptor) of interest can be found on one or more tumor cells. In some embodiments, the chimeric proteins of the invention comprise two or more targeting moieties. In such embodiments, the chimeric proteins can target two different cells (e.g., to make a synapse) or the same cell (e.g., to get a more concentrated signaling agent effect). In some embodiments, the present chimeric proteins may directly or indirectly recruit an immune cell, e.g., in some embodiments, to a therapeutic site (e.g., a locus with one or more disease cell or cell to be modulated for a therapeutic effect). In some embodiments, the present chimeric proteins may directly or indirectly recruit an immune cell, e.g., an immune cell that can kill and/or suppress a tumor cell, to a site of action (such as, by way of non-limiting example, the tumor microenvironment).

In various embodiments, the targeting moieties can directly or indirectly recruit cells, such as disease cells and/or effector cells. In various embodiments, the signaling agent (e.g., modified IFN-γ) can modulate one or more cells that are targeted by the targeting moieties (e.g., recruited cells, such as disease cells and/or effector cells). For instance, the signaling agent (e.g., modified IFN-γ) can modulate one or both of the targeted cells (and the targeted cells can be effector and/or disease cells), depending on whether the targeted cells express a receptor for the signaling agent.

In some embodiments, the present chimeric proteins are capable of, or find use in methods involving, shifting the balance of immune cells in favor of immune attack of a tumor. For instance, the present chimeric proteins can shift the ratio of immune cells at a site of clinical importance in favor of cells that can kill and/or suppress a tumor (e.g., T cells, cytotoxic T lymphocytes, T helper cells, natural killer (NK) cells, natural killer T (NKT) cells, anti-tumor macrophages (e.g., M1 macrophages), B cells, dendritic cells, or subsets thereof) and in opposition to cells that protect tumors (e.g., myeloid-derived suppressor cells (MDSCs), regulatory T cells (Tregs); tumor associated neutrophils (TANs), M2 macrophages, tumor associated macrophages (TAMs), or subsets thereof). In some embodiments, the present chimeric protein is capable of increasing a ratio of effector T cells to regulatory T cells.

For example, in some embodiments, the recognition domains specifically bind to a target (e.g., antigen, receptor) associated with T cells. In some embodiments, the recognition domains directly or indirectly recruit T cells. In an embodiment, the recognition domains specifically bind to effector T cells. In some embodiments, the recognition domain directly or indirectly recruits effector T cells, e.g., in some embodiments, to a therapeutic site (e.g., a locus with one or more disease cell or cell to be modulated for a therapeutic effect). Illustrative effector T cells include cytotoxic T cells (e.g., αβ TCR, $CD3^+$, $CD8^+$, $CD45RO^+$); $CD4^+$ effector T cells (e.g., αβ TCR, $CD3^+$, $CD4^+$, $CCR7^+$, CD62Lhi, IL-7R/$CD127^+$); $CD8^+$ effector T cells (e.g., αβ TCR, $CD3^+$, $CD8^+$, $CCR7^+$, CD62Lhi, IL-7 R/$CD127^+$); effector memory T cells (e.g., CD62Llow, $CD44^+$, TCR, $CD3^+$, IL-7 R/$CD127^+$, IL-15$R^+$, CCR7low); central memory T cells (e.g., $CCR7^+$, $CD62L^+$, $CD27^+$; or CCR7hi, $CD44^+$, CD62Lhi, TCR, $CD3^+$, IL-7R/$CD127^+$, IL-15$R^+$); $CD62L^+$ effector T cells; $CD8^+$ effector memory T cells (TEM) including early effector memory T cells ($CD27^+$ $CD62L^-$) and late effector memory T cells ($CD27^-$ $CD62L^-$) (TemE and TemL, respectively); CD127($^+$)CD25(low/−) effector T cells; CD127($^-$) CD25($^-$) effector T cells; $CD8^+$ stem cell memory effector cells (TSCM) (e.g., CD44(low) CD62L(high)CD122(high)sca($^+$)); TH1 effector T-cells (e.g., $CXCR3^+$, $CXCR6^+$ and $CCR5^+$; or αβ TCR, $CD3^+$, $CD4^+$, IL-12$R^+$, IFNγ$R^+$, $CXCR3^+$), TH2 effector T cells (e.g., $CCR3^+$, $CCR4^+$ and $CCR8^+$; or αβ TCR, $CD3^+$, $CD4^+$, IL-4$R^+$, IL-33$R^+$, $CCR4^+$, IL-17$RB^+$, $CRTH2^+$); TH9 effector T cells (e.g., αβ TCR, $CD3^+$, $CD4^+$); TH17 effector T cells (e.g., αβ TCR, $CD3^+$, $CD4^+$, IL-23$R^+$, $CCR6^+$, IL-1$R^+$); $CD4^+$ $CD45RO^+CCR7^+$ effector T cells, $ICOS^+$ effector T cells; $CD4^+$ $CD45RO^+CCR7^{(-)}$ effector T cells; and effector T cells secreting IL-2, IL-4 and/or IFN-γ.

Illustrative T cell antigens of interest include, for example (and inclusive of the extracellular domains, where applicable): CD8, CD3, SLAMF4, IL-2Rα, 4-1BB/TNFRSF9, IL-2 R β, ALCAM, B7-1, IL-4 R, B7-H3, BLAME/SLAMFS, CEACAM1, IL-6 R, CCR3, IL-7 Rα, CCR4, CXCRI/IL-S RA, CCR5, CCR6, IL-10R α, CCR 7, IL-I 0 R β, CCRS, IL-12 R β 1, CCR9, IL-12 R β 2, CD2, IL-13 R α 1, IL-13, CD3, CD4, ILT2/CDS5j, ILT3/CDS5k, ILT4/CDS5d, ILT5/CDS5a, lutegrin α 4/CD49d, CDS, Integrin α E/CD103, CD6, Integrin α M/CD 11 b, CDS, Integrin α X/CD11c, Integrin β 2/CDIS, KIR/CD15S, CD27/TNFRSF7, KIR2DL1, CD2S, KIR2DL3, CD30/TNFRSFS, KIR2DL4/CD15Sd, CD31/PECAM-1, KIR2DS4, CD40 Ligand/TNFSF5, LAG-3, CD43, LAIR1, CD45, LAIR2, CDS3, Leukotriene B4-R1, CDS4/SLAMF5, NCAM-L1, CD94, NKG2A, CD97, NKG2C, CD229/SLAMF3, NKG2D, CD2F-10/SLAMF9, NT-4, CD69, NTB-A/SLAMF6, Common γ Chain/IL-2 R γ, Osteopontin, CRACC/SLAMF7, PD-1, CRTAM, PSGL-1, CTLA-4, RANK/TNFRS11A, CX3CR1, CX3CL1, L-Selectin, CXCR3, SIRP β 1, CXCR4, SLAM, CXCR6, TCCR/WSX-1, DNAM-1, Thymopoietin, EMMPRIN/CD147, TIM-1, EphB6, TIM-2, Fas/TNFRSF6, TIM-3, Fas Ligand/TNFSF6, TIM-4, Fcγ RIII/CD16, TIM-6, TNFR1/TNFRSF1A, Granulysin, TNF RIII/TNFRSF1B, TRAIL RI/TNFRSF10A, ICAM-1/CD54, TRAIL R2/TNFRSF10B, ICAM-2/CD102, TRAILR3/TNFRSF10C, IFN-γR1, TRAILR4/TNFRSF10D, IFN-γ R2, TSLP, IL-1 R1 and TSLP R. In various embodiments, a targeting moiety of the chimeric protein binds one or more of these illustrative T cell antigens.

By way of non-limiting example, in various embodiments, the present chimeric protein has a targeting moiety directed against a checkpoint marker expressed on a T cell, e.g., one or more of PD-1, CD28, CTLA4, ICOS, BTLA, KIR, LAG3, CD137, OX40, CD27, CD40L, TIM3, and A2aR.

For example, in some embodiments, the recognition domains specifically bind to a target (e.g., antigen, receptor) associated with B cells. In some embodiments, the recognition domains directly or indirectly recruit B cells, e.g., in some embodiments, to a therapeutic site (e.g., a locus with one or more disease cell or cell to be modulated for a therapeutic effect). Illustrative B cell antigens of interest include, for example, CD10, CD19, CD20, CD21, CD22, CD23, CD24, CD37, CD38, CD39, CD40, CD70, CD72, CD73, CD74, CDw75, CDw76, CD77, CD78, CD79a/b, CD80, CD81, CD82, CD83, CD84, CD85, CD86, CD89, CD98, CD126, CD127, CDw130, CD138, CDw150 and B-cell maturation antigen (BCMA). In various embodiments, a targeting moiety of the chimeric protein binds one or more of these illustrative B cell antigens.

By way of further example, in some embodiments, the recognition domains specifically bind to a target (e.g., antigen, receptor) associated with Natural Killer cells. In some embodiments, the recognition domains directly or indirectly recruit Natural Killer cells, e.g., in some embodiments, to a therapeutic site (e.g., a locus with one or more disease cell or cell to be modulated for a therapeutic effect). Illustrative Natural Killer cell antigens of interest include, for example TIGIT, 2B4/SLAMF4, KIR2DS4, CD155/PVR, KIR3DL1, CD94, LMIR1/CD300A, CD69, LMIR2/CD300c, CRACC/SLAMF7, LMIR3/CD300LF, DNAM-1, LMIR5/CD300LB, Fc-epsilon RII, LMIR6/CD300LE, Fc-γ RI/CD64, MICA, Fc-γ RIIB/CD32b, MICB, Fc-γ RIIC/CD32c, MULT-1, Fc-γ RIIA/CD32a, Nectin-2/CD112, Fc-γ RIII/CD16, NKG2A, FcRH1/IRTA5, NKG2C, FcRH2/IRTA4, NKG2D, FcRH4/IRTA1, NKp30, FcRH5/IRTA2, NKp44, Fc-Receptor-like 3/CD16-2, NKp46/NCR1, NKp80/KLRF1, NTB-A/SLAMF6, Rae-1, Rae-1 α, Rae-1 β, Rae-1 delta, H60, Rae-1 epsilon, ILT2/CD85j, Rae-1 γ, ILT3/CD85k, TREM-1, ILT4/CD85d, TREM-2, ILT5/CD85a, TREM-3, KIR/CD158, TREML1/TLT-1, KIR2DL1, ULBP-1, KIR2DL3, ULBP-2, KIR2DL4/CD158d and ULBP-3. In various embodiments, a targeting moiety of the chimeric protein binds one or more of these illustrative NK cell antigens.

Also, in some embodiments, the recognition domains specifically bind to a target (e.g., antigen, receptor) associated with macrophages/monocytes. In some embodiments, the recognition domains directly or indirectly recruit macrophages/monocytes, e.g., in some embodiments, to a therapeutic site (e.g., a locus with one or more disease cell or cell to be modulated for a therapeutic effect). Illustrative macrophages/monocyte antigens of interest include, for example SIRP1a, B7-1/CD80, ILT4/CD85d, B7-H1, ILT5/CD85a, Common β Chain, Integrin α 4/CD49d, BLAME/SLAMF8, Integrin α X/CDIIc, CCL6/C10, Integrin β 2/CD18, CD155/PVR, Integrin β 3/CD61, CD31/PECAM-1, Latexin, CD36/SR-B3, Leukotriene B4 R1, CD40/TNFRSF5, LIMPIIISR-B2, CD43, LMIR1/CD300A, CD45, LMIR2/CD300c, CD68, LMIR3/CD300LF, CD84/SLAMF5, LMIR5/ CD300LB, CD97, LMIR6/CD300LE, CD163, LRP-1, CD2F-10/SLAMF9, MARCO, CRACC/SLAMF7, MD-1, ECF-L, MD-2, EMMPRIN/CD147, MGL2, Endoglin/ CD105, Osteoactivin/GPNMB, Fc-γ RI/CD64, Osteopontin, Fc-γ RIIB/CD32b, PD-L2, Fc-γ RIIC/CD32c, Siglec-3/ CD33, Fc-γ RIIA/CD32a, SIGNR1/CD209, Fc-γ RIII/ CD16, SLAM, GM-CSF R α, TCCR/WSX-1, ICAM-2/ CD102, TLR3, IFN-γ RI, TLR4, IFN-gannna R2, TREM-I, IL-I RII, TREM-2, ILT2/CD85j, TREM-3, ILT3/CD85k, TREML1/TLT-1, 2B4/SLAMF 4, IL-10 R α, ALCAM, IL-10 R13, AminopeptidaseN/ANPEP, ILT2/CD85j, Common β Chain, ILT3/CD85k, Clq R1/CD93, ILT4/CD85d, CCR1, ILT5/CD85a, CCR2, Integrin α 4/CD49d, CCR5, Integrin α M/CDII b, CCR8, Integrin α X/CDIIc, CD155/ PVR, Integrin β 2/CD18, CD14, Integrin β 3/CD61, CD36/ SR-B3, LAIR1, CD43, LAIR2, CD45, Leukotriene B4-R1, CD68, LIMPIIISR-B2, CD84/SLAMF5, LMIR1/CD300A, CD97, LMIR2/CD300c, LMIR3/CD300LF, Coagulation Factor III/Tissue Factor, LMIR5/CD300LB, CX3CR1, CX3CL1, LMIR6/CD300LE, CXCR4, LRP-1, CXCR6, M-CSF R, DEP-1/CD148, MD-1, DNAM-1, MD-2, EMMPRIN/CD147, MMR, Endoglin/CD105, NCAM-L1, Fc-γ RI/CD64, PSGL-1, Fc-γ RIIICD16, RP105, G-CSF R, L-Selectin, GM-CSF R α, Siglec-3/CD33, HVEM/TN-FRSF14, SLAM, ICAM-1/CD54, TCCR/WSX-1, ICAM-2/ CD102, TREM-I, IL-6 R, TREM-2, CXCRI/IL-8 RA, TREM-3 and TREMLI/TLT-1. In various embodiments, a targeting moiety of the chimeric protein binds one or more of these illustrative macrophage/monocyte antigens.

Also, in some embodiments, the recognition domains specifically bind to a target (e.g., antigen, receptor) associated with dendritic cells. In some embodiments, the recognition domains directly or indirectly recruit dendritic cells, e.g., in some embodiments, to a therapeutic site (e.g., a locus with one or more disease cell or cell to be modulated for a therapeutic effect). Illustrative dendritic cell antigens of interest include, for example, CLEC9A, XCR1, RANK, CD36/SRB3, LOX-1/SR-E1, CD68, MARCO, CD163, SR-A1/MSR, CD5L, SREC-1, CL-PI/COLEC12, SREC-II, LIMPIIISRB2, RP105, TLR4, TLR1, TLR5, TLR2, TLR6, TLR3, TLR9, 4-IBB Ligand/TNFSF9, IL-12/IL-23 p40, 4-Amino-1,8-naphthalimide, ILT2/CD85j, CCL21/6Ckine, ILT3/CD85k, 8-oxo-dG, ILT4/CD85d, 8D6A, ILT5/CD85a, A2B5, lutegrin α 4/CD49d, Aag, Integrin β 2/CD18, AMICA, Langerin, B7-2/CD86, Leukotriene B4 RI, B7-H3, LMIR1/CD300A, BLAME/SLAMF8, LMIR2/CD300c, Clq R1/CD93, LMIR3/CD300LF, CCR6, LMIR5/CD300LB CCR7, LMIR6/CD300LE, CD40/TNFRSF5, MAG/Siglec-4-a, CD43, MCAM, CD45, MD-1, CD68, MD-2, CD83, MDL-1/CLEC5A, CD84/SLAMF5, MMR, CD97, NCAMLI, CD2F-10/SLAMF9, Osteoactivin GPNMB, Chern 23, PD-L2, CLEC-1, RP105, CLEC-2, CLEC-8, Siglec-2/CD22, CRACC/SLAMF7, Siglec-3/CD33, DC-SIGN, Siglec-5, DC-SIGNR/CD299, Siglec-6, DCAR, Siglec-7, DCIR/CLEC4A, Siglec-9, DEC-205, Siglec-10, Dectin-1/CLEC7A, Siglec-F, Dectin-2/CLEC6A, SIGNR1/ CD209, DEP-1/CD148, SIGNR4, DLEC, SLAM, EMMPRIN/CD147, TCCR/WSX-1, Fc-γ R1/CD64, TLR3, Fc-γ RIIB/CD32b, TREM-1, Fc-γ RIIC/CD32c, TREM-2, Fc-γ RIIA/CD32a, TREM-3, Fc-γ RIII/CD16, TREML1/TLT-1, ICAM-2/CD102 and Vanilloid R1. In various embodiments, a targeting moiety of the chimeric protein binds one or more of these illustrative DC antigens.

In some embodiments, the recognition domains specifically bind to a target (e.g., antigen, receptor) on immune cells selected from, but not limited to, megakaryocytes, thrombocytes, erythrocytes, mast cells, basophils, neutrophils, eosinophils, or subsets thereof. In some embodiments, the recognition domains directly or indirectly recruit megakaryocytes, thrombocytes, erythrocytes, mast cells, basophils, neutrophils, eosinophils, or subsets thereof, e.g., in some embodiments, to a therapeutic site (e.g., a locus with one or more disease cell or cell to be modulated for a therapeutic effect).

In some embodiments, the recognition domains specifically bind to a target (e.g., antigen, receptor) associated with megakaryocytes and/or thrombocytes. Illustrative megakaryocyte and/or thrombocyte antigens of interest include, for example, GP IIb/IIIa, GPIb, vWF, PF4, and TSP. In various embodiments, a targeting moiety of the chimeric protein binds one or more of these illustrative megakaryocyte and/or thrombocyte antigens.

In some embodiments, the recognition domains specifically bind to a target (e.g., antigen, receptor) associated with erythrocytes. Illustrative erythrocyte antigens of interest include, for example, CD34, CD36, CD38, CD41a (platelet glycoprotein IIb/IIIa), CD41b (GPIIb), CD71 (transferrin receptor), CD105, glycophorin A, glycophorin C, c-kit, HLA-DR, H2 (MHC-II), and Rhesus antigens. In various embodiments, a targeting moiety of the chimeric protein binds one or more of these illustrative erythrocyte antigens.

In some embodiments, the recognition domains specifically bind to a target (e.g., antigen, receptor) associated with mast cells. Illustrative mast cells antigens of interest include, for example, SCFR/CD117, Fc$_\varepsilon$RI, CD2, CD25, CD35, CD88, CD203c, C5R1, CMAI, FCERIA, FCER2, TPSABI. In various embodiments, a targeting moiety of the chimeric protein binds one or more of these mast cell antigens.

In some embodiments, the recognition domains specifically bind to a target (e.g., antigen, receptor) associated with basophils. Illustrative basophils antigens of interest include, for example, Fc$_\varepsilon$RI, CD203c, CD123, CD13, CD107a, CD107b, and CD164. In various embodiments, a targeting moiety of the chimeric protein binds one or more of these basophil antigens.

In some embodiments, the recognition domains specifically bind to a target (e.g., antigen, receptor) associated with neutrophils. Illustrative neutrophils antigens of interest include, for example, 7D5, CD10/CALLA, CD13, CD16 (FcRIII), CD18 proteins (LFA-1, CR3, and p150, 95), CD45, CD67, and CD177. In various embodiments, a targeting moiety of the chimeric protein binds one or more of these neutrophil antigens.

In some embodiments, the recognition domains specifically bind to a target (e.g., antigen, receptor) associated with eosinophils. Illustrative eosinophils antigens of interest include, for example, CD35, CD44 and CD69. In various embodiments, a targeting moiety of the chimeric protein binds one or more of these eosinophil antigens.

In various embodiments, the recognition domain may bind to any appropriate target, antigen, receptor, or cell surface markers known by the skilled artisan. In some embodiments, the antigen or cell surface marker is a tissue-specific marker. Illustrative tissue-specific markers include, but are not limited to, endothelial cell surface markers such as ACE, CD14, CD34, CDH5, ENG, ICAM2, MCAM, NOS3, PECAMI, PROCR, SELE, SELP, TEK, THBD, VCAMI, VWF; smooth muscle cell surface markers such as ACTA2, MYHIO, MYHI1, MYH9, MYOCD; fibroblast (stromal) cell surface markers such as ALCAM, CD34, COLIAI, COL1A2, COL3A1, FAP, PH-4; epithelial cell surface markers such as CDID, K6IRS2, KRTIO, KRT13, KRT17, KRT18, KRT19, KRT4, KRT5, KRT8, MUCI, TACSTDI; neovasculature markers such as CD13, TFNA, Alpha-v beta-3 ($\alpha_v\beta_3$), E-selectin; and adipocyte surface markers such as ADIPOQ, FABP4, and RETN. In various embodiments, a targeting moiety of the chimeric protein binds one or more of these antigens. In various embodiments, a targeting moiety of the chimeric protein binds one or more of cells having these antigens.

In some embodiments, the recognition domains specifically bind to a target (e.g., antigen, receptor) associated with tumor cells. In some embodiments, the recognition domains directly or indirectly recruit tumor cells. For instance, in some embodiments, the direct or indirect recruitment of the tumor cell is to one or more effector cell (e.g., an immune cell as described herein) that can kill and/or suppress the tumor cell.

Tumor cells, or cancer cells refer to an uncontrolled growth of cells or tissues and/or an abnormal increased in cell survival and/or inhibition of apoptosis which interferes with the normal functioning of bodily organs and systems. For example, tumor cells include benign and malignant cancers, polyps, hyperplasia, as well as dormant tumors or micrometastases. Illustrative tumor cells include, but are not limited to cells of: basal cell carcinoma, biliary tract cancer; bladder cancer; bone cancer; brain and central nervous system cancer; breast cancer; cancer of the peritoneum; cervical cancer; choriocarcinoma; colon and rectum cancer; connective tissue cancer; cancer of the digestive system; endometrial cancer; esophageal cancer; eye cancer; cancer of the head and neck; gastric cancer (including gastrointestinal cancer); glioblastoma; hepatic carcinoma; hepatoma; intra-epithelial neoplasm; kidney or renal cancer; larynx cancer; leukemia; liver cancer; lung cancer (e.g., small-cell lung cancer, non-small cell lung cancer, adenocarcinoma of the lung, and squamous carcinoma of the lung); melanoma; myeloma; neuroblastoma; oral cavity cancer (lip, tongue, mouth, and pharynx); ovarian cancer; pancreatic cancer; prostate cancer; retinoblastoma; rhabdomyosarcoma; rectal cancer; cancer of the respiratory system; salivary gland carcinoma; sarcoma; skin cancer; squamous cell cancer; stomach cancer; testicular cancer; thyroid cancer; uterine or endometrial cancer; cancer of the urinary system; vulval cancer; lymphoma including Hodgkin's and non-Hodgkin's lymphoma, as well as B-cell lymphoma (including low grade/follicular non-Hodgkin's lymphoma (NHL); small lymphocytic (SL) NHL; intermediate grade/follicular NHL; intermediate grade diffuse NHL; high grade immunoblastic NHL; high grade lymphoblastic NHL; high grade small non-cleaved cell NHL; bulky disease NHL; mantle cell lymphoma; AIDS-related lymphoma; and Waldenstrom's Macroglobulinemia; chronic lymphocytic leukemia (CLL); acute lymphoblastic leukemia (ALL); Hairy cell leukemia; chronic myeloblastic leukemia; as well as other carcinomas and sarcomas; and post-transplant lymphoproliferative disorder (PTLD), as well as abnormal vascular proliferation associated with phakomatoses, edema (e.g., that associated with brain tumors), and Meigs' syndrome.

Tumor cells, or cancer cells also include, but are not limited to, carcinomas, e.g., various subtypes, including, for example, adenocarcinoma, basal cell carcinoma, squamous cell carcinoma, and transitional cell carcinoma), sarcomas (including, for example, bone and soft tissue), leukemias (including, for example, acute myeloid, acute lymphoblastic, chronic myeloid, chronic lymphocytic, and hairy cell), lymphomas and myelomas (including, for example, Hodgkin and non-Hodgkin lymphomas, light chain, non-secretory, MGUS, and plasmacytomas), and central nervous system cancers (including, for example, brain (e.g., gliomas (e.g., astrocytoma, oligodendroglioma, and ependymoma), meningioma, pituitary adenoma, and neuromas, and spinal cord tumors (e.g., meningiomas and neurofibroma).

Illustrative tumor antigens include, but are not limited to, MART-1/Melan-A, gp100, Dipeptidyl peptidase IV (DP-PIV), adenosine deaminase-binding protein (ADAbp), cyclophilin b, Colorectal associated antigen (CRC)-0017-1A/GA733, Carcinoembryonic Antigen (CEA) and its immunogenic epitopes CAP-1 and CAP-2, etv6, am11, Prostate Specific Antigen (PSA) and its immunogenic epitopes PSA-1, PSA-2, and PSA-3, prostate-specific membrane antigen (PSMA), T-cell receptor/CD3-zeta chain, MAGE-family of tumor antigens (e.g., MAGE-A1, MAGE-A2, MAGE-A3, MAGE-A4, MAGE-A5, MAGE-A6, MAGE-A7, MAGE-A8, MAGE-A9, MAGE-A10, MAGE-A11, MAGE-A12, MAGE-Xp2 (MAGE-B2), MAGE-Xp3 (MAGE-B3), MAGE-Xp4 (MAGE-B4), MAGE-C1, MAGE-C2, MAGE-C3, MAGE-C4, MAGE-05), GAGE-family of tumor antigens (e.g., GAGE-1, GAGE-2, GAGE-3, GAGE-4, GAGE-5, GAGE-6, GAGE-7, GAGE-8, GAGE-9), BAGE, RAGE, LAGE-1, NAG, GnT-V, MUM-1, CDK4, tyrosinase, p53, MUC family, HER2/neu, p21ras, RCAS1, $\alpha$-fetoprotein, E-cadherin, $\alpha$-catenin, $\beta$-catenin and $\gamma$-catenin, p120ctn, gp100 PmeI117, PRAME, NY-ESO-1, cdc27, adenomatous polyposis coli protein (APC), fodrin, Connexin 37, Ig-idiotype, p15, gp75, GM2 and GD2 gangliosides, viral products such as human papilloma virus proteins, Smad family of tumor antigens, Imp-1, NA, EBV-encoded nuclear antigen (EBNA)-1, brain glycogen phosphorylase, SSX-1, SSX-2 (HOM-MEL-40), SSX-1, SSX-4, SSX-5, SCP-1 CT-7, c-erbB-2, CD19, CD20, CD22, CD30, CD33, CD37, CD56, CD70, CD74, CD138, AGS16, MUC1, GPNMB, Ep-CAM, PD-L1, PD-L2, and PMSA. In various embodiments, a targeting moiety of the chimeric protein binds one or more of these tumor antigens.

In various embodiments, the chimeric proteins of the invention have targeting moieties having recognition domains which specifically bind to a target (e.g., antigen, receptor) which is part of a non-cellular structure. In some embodiments, the antigen or receptor is not an integral component of an intact cell or cellular structure. In some embodiments, the antigen or receptor is an extracellular antigen or receptor. In some embodiments, the target is a non-proteinaceous, non-cellular marker, including, without limitation, nucleic acids, inclusive of DNA or RNA, such as, for example, DNA released from necrotic tumor cells or extracellular deposits such as cholesterol.

In some embodiments, the target (e.g., antigen, receptor) of interest is part of the non-cellular component of the stroma or the extracellular matrix (ECM) or the markers associated therewith. As used herein, stroma refers to the connective and supportive framework of a tissue or organ. Stroma may include a compilation of cells such as fibroblasts/myofibroblasts, glial, epithelia, fat, immune, vascular, smooth muscle, and immune cells along with the extracellular matrix (ECM) and extracellular molecules. In various embodiments, the target (e.g., antigen, receptor) of interest is part of the non-cellular component of the stroma such as the extracellular matrix and extracellular molecules. As used herein, the ECM refers to the non-cellular components present within all tissues and organs. The ECM is composed of a large collection of biochemically distinct components including, without limitation, proteins, glycoproteins, proteoglycans, and polysaccharides. These components of the ECM are usually produced by adjacent cells and secreted into the ECM via exocytosis. Once secreted, the ECM components often aggregate to form a complex network of macromolecules. In various embodiments, the chimeric protein of the invention comprises a targeting moiety that recognizes a target (e.g., an antigen or receptor or non-proteinaceous molecule) located on any component of the ECM. Illustrative components of the ECM include, without limitation, the proteoglycans, the non-proteoglycan polysaccharides, fibers, and other ECM proteins or ECM non-proteins, e.g., polysaccharides and/or lipids, or ECM associated molecules (e.g., proteins or non-proteins, e.g., polysaccharides, nucleic acids and/or lipids).

In some embodiments, the targeting moiety recognizes a target (e.g., antigen, receptor) on ECM proteoglycans. Proteoglycans are glycosylated proteins. The basic proteoglycan unit includes a core protein with one or more covalently attached glycosaminoglycan (GAG) chains. Proteoglycans have a net negative charge that attracts positively charged sodium ions (Na+), which attracts water molecules via osmosis, keeping the ECM and resident cells hydrated. Proteoglycans may also help to trap and store growth factors within the ECM. Illustrative proteoglycans that may be targeted by the chimeric proteins of the invention include, but are not limited to, heparan sulfate, chondroitin sulfate, and keratan sulfate. In an embodiment, the targeting moiety recognizes a target (e.g., antigen, receptor) on non-proteoglycan polysaccharides such as hyaluronic acid.

In some embodiments, the targeting moiety recognizes a target (e.g., antigen, receptor) on ECM fibers. ECM fibers include collagen fibers and elastin fibers. In some embodiments, the targeting moiety recognizes one or more epitopes on collagens or collagen fibers. Collagens are the most abundant proteins in the ECM. Collagens are present in the ECM as fibrillar proteins and provide structural support to resident cells. In one or more embodiments, the targeting moiety recognizes and binds to various types of collagens present within the ECM including, without limitation, fibrillar collagens (types I, II, III, V, XI), facit collagens (types IX, XII, XIV), short chain collagens (types VIII, X), basement membrane collagens (type IV), and/or collagen types VI, VII, or XIII. Elastin fibers provide elasticity to tissues, allowing them to stretch when needed and then return to their original state. In some embodiments, the target moiety recognizes one or more epitopes on elastins or elastin fibers.

In some embodiments, the targeting moiety recognizes one or more ECM proteins including, but not limited to, a tenascin, a fibronectin, a fibrin, a laminin, or a nidogen/entactin.

In an embodiment, the targeting moiety recognizes and binds to tenascin. The tenascin (TN) family of glycoproteins includes at least four members, tenascin-C, tenascin-R, tenascin-X, and tenascin W. The primary structures of tenascin proteins include several common motifs ordered in the same consecutive sequence: amino-terminal heptad repeats, epidermal growth factor (EGF)-like repeats, fibronectin type III domain repeats, and a carboxyl-terminal fibrinogen-like globular domain. Each protein member is associated with typical variations in the number and nature of EGF-like and fibronectin type III repeats. Isoform variants also exist particularly with respect to tenascin-C. Over 27 splice variants and/or isoforms of tenascin-C are known. In a particular embodiment, the targeting moiety recognizes and binds to tenascin-CA1. Similarly, tenascin-R also has various splice variants and isoforms. Tenascin-R usually exists as dimers or trimers. Tenascin-X is the largest member of the tenascin family and is known to exist as trimers. Tenascin-W exists as trimers. In some embodiments, the targeting moiety recognizes one or more epitopes on a tenascin protein. In some embodiments, the targeting moiety recognizes the monomeric and/or the dimeric and/or the trimeric and/or the hexameric forms of a tenascin protein.

In an embodiment, the targeting moieties recognize and bind to fibronectin. Fibronectins are glycoproteins that connect cells with collagen fibers in the ECM, allowing cells to move through the ECM. Upon binding to integrins, fibronectins unfolds to form functional dimers. In some embodiments, the targeting moiety recognizes the monomeric and/or the dimeric forms of fibronectin. In some embodiments, the targeting moiety recognizes one or more epitopes on fibronectin. In illustrative embodiments, the targeting moiety recognizes fibronectin extracellular domain A (EDA) or fibronectin extracellular domain B (EDB). Elevated levels of EDA are associated with various diseases and disorders including psoriasis, rheumatoid arthritis, diabetes, and cancer. In some embodiments, the targeting moiety recognizes fibronectin that contains the EDA isoform and may be utilized to target the chimeric protein to diseased cells including cancer cells. In some embodiments, the targeting moiety recognizes fibronectin that contains the EDB isoform. In various embodiments, such targeting moieties may be utilized to target the chimeric protein to tumor cells including the tumor neovasculature.

In an embodiment, the targeting moiety recognizes and binds to fibrin. Fibrin is another protein substance often found in the matrix network of the ECM. Fibrin is formed by the action of the protease thrombin on fibrinogen which causes the fibrin to polymerize. In some embodiments, the targeting moiety recognizes one or more epitopes on fibrin. In some embodiments, the targeting moiety recognizes the monomeric as well as the polymerized forms of fibrin.

In an embodiment, the targeting moiety recognizes and binds to laminin. Laminin is a major component of the basal lamina, which is a protein network foundation for cells and organs. Laminins are heterotrimeric proteins that contain an α-chain, a β-chain, and a γ-chain. In some embodiments, the targeting moiety recognizes one or more epitopes on laminin. In some embodiments, the targeting moiety recognizes the monomeric, the dimeric as well as the trimeric forms of laminin.

In an embodiment, the targeting moiety recognizes and binds to a nidogen or entactin. Nidogens/entactins are a family of highly conserved, sulfated glycoproteins. They make up the major structural component of the basement membranes and function to link laminin and collagen IV networks in basement membranes. Members of this family include nidogen-1 and nidogen-2. In various embodiments, the targeting moiety recognizes an epitope on nidogen-1 and/or nidogen-2.

In various embodiments, the targeting moiety comprises an antigen recognition domain that recognizes an epitope present on any of the targets (e.g., ECM proteins) described herein. In an embodiment, the antigen-recognition domain recognizes one or more linear epitopes present on the protein. As used herein, a linear epitope refers to any continuous sequence of amino acids present on the protein. In another embodiment, the antigen-recognition domain recognizes one or more conformational epitopes present on the protein. As used herein, a conformation epitope refers to one or more sections of amino acids (which may be discontinuous) which form a three-dimensional surface with features and/or shapes and/or tertiary structures capable of being recognized by an antigen recognition domain.

In various embodiments, the targeting moiety may bind to the full-length and/or mature forms and/or isoforms and/or splice variants and/or fragments and/or any other naturally occurring or synthetic analogs, variants, or mutants of any of the targets (e.g., ECM proteins) described herein. In various embodiments, the targeting moiety may bind to any forms of the proteins described herein, including monomeric, dimeric, trimeric, tetrameric, heterodimeric, multimeric and associated forms. In various embodiments, the targeting moiety may bind to any post-translationally modified forms of the proteins described herein, such as glycosylated and/or phosphorylated forms.

In various embodiments, the targeting moiety comprises an antigen recognition domain that recognizes extracellular molecules such as DNA. In some embodiments, the targeting moiety comprises an antigen recognition domain that recognizes DNA. In an embodiment, the DNA is shed into the extracellular space from necrotic or apoptotic tumor cells or other diseased cells.

In various embodiments, the targeting moiety comprises an antigen recognition domain that recognizes one or more non-cellular structures associated with atherosclerotic plaques. Two types of atherosclerotic plaques are known. The fibro-lipid (fibro-fatty) plaque is characterized by an accumulation of lipid-laden cells underneath the intima of the arteries. Beneath the endothelium there is a fibrous cap covering the atheromatous core of the plaque. The core includes lipid-laden cells (macrophages and smooth muscle cells) with elevated tissue cholesterol and cholesterol ester content, fibrin, proteoglycans, collagen, elastin, and cellular debris. In advanced plaques, the central core of the plaque usually contains extracellular cholesterol deposits (released from dead cells), which form areas of cholesterol crystals with empty, needle-like clefts. At the periphery of the plaque are younger foamy cells and capillaries. A fibrous plaque is also localized under the intima, within the wall of the artery resulting in thickening and expansion of the wall and, sometimes, spotty localized narrowing of the lumen with some atrophy of the muscular layer. The fibrous plaque contains collagen fibers (eosinophilic), precipitates of calcium (hematoxylinophilic) and lipid-laden cells. In some embodiments, the targeting moiety recognizes and binds to one or more of the non-cellular components of these plaques such as the fibrin, proteoglycans, collagen, elastin, cellular debris, and calcium or other mineral deposits or precipitates. In some embodiments, the cellular debris is a nucleic acid, e.g., DNA or RNA, released from dead cells.

In various embodiments, the targeting moiety comprises an antigen recognition domain that recognizes one or more non-cellular structures found in the brain plaques associated with neurodegenerative diseases. In some embodiments, the targeting moiety recognizes and binds to one or more non-cellular structures located in the amyloid plaques found in the brains of patients with Alzheimer's disease. For example, the targeting moiety may recognize and bind to the peptide amyloid beta, which is a major component of the amyloid plaques. In some embodiments, the targeting moiety recognizes and binds to one or more non-cellular structures located in the brains plaques found in patients with Huntington's disease. In various embodiments, the targeting moiety recognizes and binds to one or more non-cellular structures found in plaques associated with other neurodegenerative or musculoskeletal diseases such as Lewy body dementia and inclusion body myositis.

In some embodiments, the present chimeric protein comprises two or more targeting moieties. In some embodiments, the present chimeric protein has (i) one or more targeting moieties directed against an immune cell selected from a T cell, a B cell, a dendritic cell, a macrophage, a NK cell, or subsets thereof and (ii) one or more targeting moieties directed against a tumor cell, along with any of the modified (e.g., mutant) signaling agents described herein (e.g., modified IFN-γ). In one embodiment, the present chimeric protein has (i) a targeting moiety directed against a T cell (including, without limitation an effector T cell) and (ii) a targeting moiety is directed against a tumor cell, along with any of the modified (e.g., mutant) signaling agents described herein (e.g., modified IFN-γ). In one embodiment, the present chimeric protein has (i) a targeting moiety directed against a B cell and (ii) a targeting moiety is directed against a tumor cell, along with any of the modified (e.g., mutant) signaling agents described herein (e.g., modified IFN-γ). In one embodiment, the present chimeric protein has (i) a targeting moiety directed against a dendritic cell and (ii) a targeting moiety is directed against a tumor cell, along with any of the modified (e.g., mutant) signaling agents described herein (e.g., modified IFN-γ). In one embodiment, the present chimeric protein has (i) a targeting moiety directed against a macrophage and (ii) a targeting moiety is directed against a tumor cell, along with any of the modified (e.g., mutant) signaling agents described herein (e.g., modified IFN-γ). In one embodiment, the present chimeric protein has (i) a targeting moiety directed against a NK cell and (ii) a targeting moiety is directed against a tumor cell, along with any of the modified (e.g., mutant) signaling agents described herein (e.g., modified IFN-γ).

By way of non-limiting example, in various embodiments, the present chimeric protein has (i) a targeting moiety directed against a T cell, for example, mediated by targeting to CD8, SLAMF4, IL-2 R α, 4-1BB/TNFRSF9, IL-2 R β, ALCAM, B7-1, IL-4 R, B7-H3, BLAME/SLAMF8, CEACAM1, IL-6 R, CCR3, IL-7 Rα, CCR4, CXCRI/IL-S RA, CCR5, CCR6, IL-10R α, CCR 7, IL-I 0 R β, CCRS, IL-12 R β 1, CCR9, IL-12 R β 2, CD2, IL-13 R α 1, IL-13, CD3, CD4, ILT2/CDS5j, ILT3/CDS5k, ILT4/CDS5d, ILT5/ CDS5a, lutegrin α 4/CD49d, CDS, Integrin α E/CD103, CD6, Integrin α M/CD 11 b, CDS, Integrin α X/CD11c, Integrin β 2/CDIS, KIR/CD15S, CD27/TNFRSF7, KIR2DL1, CD2S, KIR2DL3, CD30/TNFRSFS, KIR2DL4/ CD15Sd, CD31/PECAM-1, KIR2DS4, CD40 Ligand/ TNFSF5, LAG-3, CD43, LAIR1, CD45, LAIR2, CDS3, Leukotriene B4-R1, CDS4/SLAMF5, NCAM-L1, CD94, NKG2A, CD97, NKG2C, CD229/SLAMF3, NKG2D, CD2F-10/SLAMF9, NT-4, CD69, NTB-A/SLAMF6, Common γ Chain/IL-2 R γ, Osteopontin, CRACC/SLAMF7, PD-1, CRTAM, PSGL-1, CTLA-4, RANK/TNFRSF11A, CX3CR1, CX3CL1, L-Selectin, CXCR3, SIRP β 1, CXCR4, SLAM, CXCR6, TCCR/WSX-1, DNAM-1, Thymopoietin, EMMPRIN/CD147, TIM-1, EphB6, TIM-2, Fas/ TNFRSF6, TIM-3, Fas Ligand/TNFSF6, TIM-4, Fcγ RIII/ CD16, TIM-6, TNFR1/TNFRSF1A, Granulysin, TNF RIII/ TNFRSF1B, TRAIL RI/TNFRSF10A, ICAM-1/CD54, TRAIL R2/TNFRSF10B, ICAM-2/CD102, TRAILR3/ TNFRSF10C, IFN-γR1, TRAILR4/TNFRSF10D, IFN-γ R2, TSLP, IL-1 R1, or TSLP R; and (ii) a targeting moiety is directed against a tumor cell, along with any of the modified (e.g., mutant) signaling agents described herein (e.g., modified IFN-γ).

By way of non-limiting example, in various embodiments, the present chimeric protein has a targeting moiety directed against (i) a checkpoint marker expressed on a T cell, e.g., one or more of PD-1, CD28, CTLA4, ICOS, BTLA, KIR, LAG3, CD137, OX40, Cd27, CD40L, TIM3, and A2aR and (ii) a targeting moiety is directed against a tumor cell, along with any of the modified (e.g., mutant) signaling agents described herein (e.g., modified IFN-γ).

In various embodiments, the present chimeric protein has one or more targeting moieties directed against PD-1. In some embodiments, the chimeric protein has one or more targeting moieties which selectively bind a PD-1 polypeptide. In some embodiments, the chimeric protein comprises one or more antibodies, antibody derivatives or formats, peptides or polypeptides, or fusion proteins that selectively bind a PD-1 polypeptide.

In an embodiment, the targeting moiety comprises a derivative of the anti-PD-1 antibody pembrolizumab (aka MK-3475, KEYTRUDA), or fragments thereof. Pembrolizumab and other humanized anti-PD-1 antibodies are disclosed in Hamid, et al. (2013) New England Journal of Medicine 369 (2): 134-44, U.S. Pat. No. 8,354,509, and WO 2009/114335, the entire disclosures of which are hereby incorporated by reference. In illustrative embodiments, pembrolizumab or an antigen-binding fragment thereof for use in the methods provided herein comprises a heavy chain comprising the amino acid sequence of: SEQ ID NO: 63; and/or a light chain comprising the amino acid sequence of SEQ ID NO: 64.

In an embodiment, the targeting moiety comprises a derivative of the anti-PD-1 antibody, nivolumab (aka BMS-936558, MDX-1106, ONO-4538, OPDIVO), or fragments thereof. Nivolumab (clone 5C4) and other human monoclonal antibodies that specifically bind to PD-1 are disclosed in U.S. Pat. No. 8,008,449 and WO 2006/121168, the entire disclosures of which are hereby incorporated by reference. In illustrative embodiments, nivolumab or an antigen-binding fragment thereof comprises a heavy chain comprising the amino acid sequence of SEQ ID NO: 65; and/or a light chain comprising the amino acid sequence of SEQ ID NO: 66.

In an embodiment, the targeting moiety comprises a derivative of the anti-PD-1 antibody pidilizumab (aka CT-011, hBAT or hBAT-1), or fragments thereof. Pidilizumab and other humanized anti-PD-I monoclonal antibodies are disclosed in US 2008/0025980 and WO 2009/101611, the entire disclosures of which are hereby incorporated by reference. In illustrative embodiments, the anti-PD-1 antibody or an antigen-binding fragment thereof for use in the methods provided herein comprises a light chain variable regions comprising an amino acid sequence selected from SEQ ID NOs: 15-18 of US 2008/0025980: SEQ ID NO: 15 of US 2008/0025980 (SEQ ID NO: 67); SEQ ID NO: 16 of US 2008/0025980 (SEQ ID NO: 68); SEQ ID NO: 17 of US 2008/0025980 (SEQ ID NO: 69); SEQ ID NO: 18 of US 2008/0025980 (SEQ ID NO: 70); and/or a heavy chain comprising an amino acid sequence selected from SEQ ID NOs: 20-24 of US 2008/0025980: SEQ ID NO: 20 of US 2008/0025980 (SEQ ID NO: 71); SEQ ID NO: 21 of US 2008/0025980 (SEQ ID NO: 72); SEQ ID NO: 22 of US 2008/0025980 (SEQ ID NO: 73); SEQ ID NO: 23 of US 2008/0025980 (SEQ ID NO: 74); SEQ ID NO: 24 of US 2008/0025980 (SEQ ID NO: 75).

In an embodiment, the targeting moiety comprises a derivative of a light chain comprising SEQ ID NO:18 of US 2008/0025980 and a derivative of a heavy chain comprising SEQ ID NO:22 of US 2008/0025980.

In an embodiment, the targeting moiety comprises a derivative of AMP-514 (aka MEDI-0680).

In an embodiment, the targeting moiety comprises a derivative of the PD-L2-Fc fusion protein AMP-224, which is disclosed in WO2010/027827 and WO 2011/066342, the entire disclosures of which are hereby incorporated by reference. In such an embodiment, the targeting moiety may include a targeting domain which comprises SEQ ID NO:4 of WO2010/027827 (SEQ ID NO: 76) and/or a derivative of the B7-DC fusion protein which comprises SEQ ID NO:83 of WO2010/027827 (SEQ ID NO: 77).

In an embodiment, the targeting moiety comprises a derivative of the peptide AUNP 12 or any of the other peptides disclosed in US 2011/0318373 or U.S. Pat. No. 8,907,053. For example, the targeting moiety may comprise a derivative of AUNP 12 (i.e., Compound 8 or SEQ ID NO:49 of US 2011/0318373) which has the sequence of SEQ ID NO: 78:

In an embodiment, the targeting moiety comprises a derivative of the anti-PD-1 antibody 1E3, or fragments thereof, as disclosed in US 2014/0044738, the entire disclosures of which are hereby incorporated by reference. In illustrative embodiments, 1E3 or an antigen-binding fragment thereof for use in the methods provided herein comprises a heavy chain variable region comprising the amino acid sequence of SEQ ID NO: 79; and/or a light chain variable region comprising the amino acid sequence of SEQ ID NO: 80.

In an embodiment, the targeting moiety comprises a derivative of the anti-PD-1 antibody 1E8, or fragments thereof, as disclosed in US 2014/0044738, the entire disclosures of which are hereby incorporated by reference. In illustrative embodiments, 1E8 or an antigen-binding fragment thereof for use in the methods provided herein comprises a heavy chain variable region comprising the amino acid sequence of SEQ ID NO: 81; and/or a light chain variable region comprising the amino acid sequence of SEQ ID NO: 82.

In an embodiment, the targeting moiety comprises a derivative of the anti-PD-1 antibody 1H3, or fragments thereof, as disclosed in US 2014/0044738, the entire disclosures of which are hereby incorporated by reference. In illustrative embodiments, 1H3 or an antigen-binding fragment thereof for use in the methods provided herein comprises a heavy chain variable region comprising the amino acid sequence of SEQ ID NO: 83; and/or light chain variable region comprising the amino acid sequence of SEQ ID NO: 84.

In an embodiment, the targeting moiety comprises a derivative of a VHH directed against PD-1 as disclosed, for example, in U.S. Pat. No. 8,907,065 and WO 2008/071447, the entire disclosures of which are hereby incorporated by reference. In illustrative embodiments, the VHHs against PD-1 comprise SEQ ID NOs: 347-351 of U.S. Pat. No. 8,907,065: SEQ ID NO: 347 of U.S. Pat. No. 8,907,065 (SEQ ID NO: 85); SEQ ID NO: 348 of U.S. Pat. No. 8,907,065 (SEQ ID NO: 86); SEQ ID NO: 349 of U.S. Pat. No. 8,907,065 (SEQ ID NO: 87); SEQ ID NO: 350 of U.S. Pat. No. 8,907,065 (SEQ ID NO: 88); SEQ ID NO: 351 of U.S. Pat. No. 8,907,065 (SEQ ID NO: 89).

In an embodiment, the targeting moiety comprises a derivative of any one of the anti-PD-1 antibodies, or fragments thereof, as disclosed in US2011/0271358 and WO2010/036959, the entire contents of which are hereby incorporated by reference. In illustrative embodiments, the antibody or an antigen-binding fragment thereof for use in the methods provided herein comprises a derivative of a heavy chain comprising an amino acid sequence selected from SEQ ID NOs: 25-29 of US2011/0271358: SEQ ID NO: 25 of US2011/0271358 (SEQ ID NO: 90); SEQ ID NO: 26 of US2011/0271358 (SEQ ID NO: 91); SEQ ID NO: 27 of US2011/0271358 (SEQ ID NO: 92); SEQ ID NO: 28 of US2011/0271358 (SEQ ID NO: 93); SEQ ID NO: 29 of US2011/0271358 (SEQ ID NO: 94); and/or a derivative of a light chain comprising an amino acid sequence selected from SEQ ID NOs: 30-33 of US2011/0271358: SEQ ID NO:

30 of US2011/0271358 (SEQ ID NO: 95); SEQ ID NO: 31 of US2011/0271358 (SEQ ID NO: 96); SEQ ID NO: 32 of US2011/0271358 (SEQ ID NO: 97); SEQ ID NO: 33 of US2011/0271358 (SEQ ID NO: 98).

In various embodiments, the present chimeric protein comprises a derivative of one or more antibodies directed against PD-1, or antibody fragments thereof, selected from TSR-042 (Tesaro, Inc.), REGN2810 (Regeneron Pharmaceuticals, Inc.), PDR001 (Novartis Pharmaceuticals), and BGB-A317 (BeiGene Ltd.)

In various embodiments, the present chimeric protein has one or more targeting moieties directed against PD-L1. In some embodiments, the chimeric protein has one or more targeting moieties which selectively bind a PD-L1 polypeptide. In some embodiments, the chimeric protein comprises one or more antibodies, antibody derivatives or formats, peptides or polypeptides, or fusion proteins that selectively bind a PD-L1 polypeptide. In various embodiments, the present chimeric protein comprises a first targeting moiety which binds to PD-L1 with low affinity.

In an embodiment, the targeting moiety comprises a derivative of the anti-PD-L1 antibody MEDI4736 (aka durvalumab), or fragments thereof. MEDI4736 is selective for PD-L1 and blocks the binding of PD-L1 to the PD-1 and CD80 receptors. MEDI4736 and antigen-binding fragments thereof for use in the methods provided herein comprises a heavy chain and a light chain or a heavy chain variable region and a light chain variable region. The sequence of MEDI4736 is disclosed in WO/2016/06272, the entire contents of which are hereby incorporated by reference. In illustrative embodiments, MEDI4736 or an antigen-binding fragment thereof for use in the methods provided herein comprises a heavy chain comprising the amino acid sequence of SEQ ID NO: 99; and/or a light chain comprising the amino acid sequence of SEQ ID NO: 100.

In illustrative embodiments, the MEDI4736 or an antigen-binding fragment thereof for use in the methods provided herein comprises a heavy chain variable region comprising the amino acid sequence of SEQ ID NO:4 of WO/2016/06272 (SEQ ID NO: 101) and/or a light chain variable region comprising the amino acid sequence of SEQ ID NO:3 of WO/2016/06272 (SEQ ID NO: 102).

In an embodiment, the targeting moiety comprises a derivative of the anti-PD-L1 antibody atezolizumab (aka MPDL3280A, RG7446), or fragments thereof. In illustrative embodiments, atezolizumab or an antigen-binding fragment thereof for use in the methods provided herein comprises a heavy chain comprising the amino acid sequence of SEQ ID NO: 103; and/or a light chain comprising the amino acid sequence of SEQ ID NO: 104.

In an embodiment, the targeting moiety comprises a derivative of the anti-PD-L1 antibody avelumab (aka MSB0010718C), or fragments thereof. In illustrative embodiments, avelumab or an antigen-binding fragment thereof for use in the methods provided herein comprises a heavy chain comprising the amino acid sequence of SEQ ID NO: 105 and/or a light chain comprising the amino acid sequence of SEQ ID NO: 106.

In an embodiment, the targeting moiety comprises a derivative of the anti-PD-L1 antibody BMS-936559 (aka 12A4, MDX-1105), or fragments thereof, as disclosed in US 2013/0309250 and WO2007/005874, the entire disclosures of which are hereby incorporated by reference. In illustrative embodiments, BMS-936559 or an antigen-binding fragment thereof for use in the methods provided herein comprises a heavy chain variable region comprising the amino acid sequence of SEQ ID NO: 107 and/or a light chain variable region comprising the amino acid sequence of SEQ ID NO: 108.

In an embodiment, the targeting moiety comprises a derivative of the anti-PD-L1 antibody 3G10, or fragments thereof, as disclosed in US 2013/0309250 and WO2007/005874, the entire disclosures of which are hereby incorporated by reference. In illustrative embodiments, 3G10 or an antigen-binding fragment thereof for use in the methods provided herein comprises a heavy chain variable region comprising the amino acid sequence of SEQ ID NO: 109 and/or a light chain variable region comprising the amino acid sequence of SEQ ID NO: 110.

In an embodiment, the targeting moiety comprises a derivative of the anti-PD-L1 antibody 10A5, or fragments thereof, as disclosed in US 2013/0309250 and WO2007/005874, the entire disclosures of which are hereby incorporated by reference. In illustrative embodiments, 10A5 or an antigen-binding fragment thereof for use in the methods provided herein comprises a heavy chain variable region comprising the amino acid sequence of SEQ ID NO: 111) and/or a light chain variable region comprising the amino acid sequence of SEQ ID NO: 112.

In an embodiment, the targeting moiety comprises a derivative of the anti-PD-L1 antibody 5F8, or fragments thereof, as disclosed in US 2013/0309250 and WO2007/005874, the entire disclosures of which are hereby incorporated by reference. In illustrative embodiments, 5F8 or an antigen-binding fragment thereof for use in the methods provided herein comprises a heavy chain variable region comprising the amino acid sequence of SEQ ID NO: 113 and/or a light chain variable region comprising the amino acid sequence of SEQ ID NO: 114.

In an embodiment, the targeting moiety comprises a derivative of the anti-PD-L1 antibody 10H10, or fragments thereof, as disclosed in US 2013/0309250 and WO2007/005874, the entire disclosures of which are hereby incorporated by reference. In illustrative embodiments, 10H10 or an antigen-binding fragment thereof for use in the methods provided herein comprises a heavy chain variable region comprising the amino acid sequence of SEQ ID NO: 115 and/or a light chain variable region comprising the amino acid sequence of SEQ ID NO: 112.

In an embodiment, the targeting moiety comprises a derivative of the anti-PD-L1 antibody 1B12, or fragments thereof, as disclosed in US 2013/0309250 and WO2007/005874, the entire disclosures of which are hereby incorporated by reference. In illustrative embodiments, 1B12 or an antigen-binding fragment thereof for use in the methods provided herein comprises a heavy chain variable region comprising the amino acid sequence of SEQ ID NO: 116 and/or a light chain variable region comprising the amino acid sequence of SEQ ID NO: 108.

In an embodiment, the targeting moiety comprises a derivative of the anti-PD-L1 antibody 7H1, or fragments thereof, as disclosed in US 2013/0309250 and WO2007/005874, the entire disclosures of which are hereby incorporated by reference. In illustrative embodiments, 7H1 or an antigen-binding fragment thereof for use in the methods provided herein comprises a heavy chain variable region comprising the amino acid sequence of SEQ ID NO: 117 and/or a light chain variable region comprising the amino acid sequence of SEQ ID NO: 108.

In an embodiment, the targeting moiety comprises a derivative of the anti-PD-L1 antibody 11E6, or fragments thereof, as disclosed in US 2013/0309250 and WO2007/005874, the entire disclosures of which are hereby incorporated by reference. In illustrative embodiments, 11E6 or an antigen-binding fragment thereof for use in the methods provided herein comprises a heavy chain variable region comprising the amino acid sequence of SEQ ID NO: 118 and/or a light chain variable region comprising the amino acid sequence of SEQ ID NO: 119.

In an embodiment, the targeting moiety comprises a derivative of the anti-PD-L1 antibody 12B7, or fragments thereof, as disclosed in US 2013/0309250 and WO2007/005874, the entire disclosures of which are hereby incorporated by reference. In illustrative embodiments, 12B7 or an antigen-binding fragment thereof for use in the methods provided herein comprises a heavy chain variable region comprising the amino acid sequence of SEQ ID NO: 120 and/or a light chain variable region comprising the amino acid sequence of SEQ ID NO: 121.

In an embodiment, the targeting moiety comprises a derivative of the anti-PD-L1 antibody 13G4, or fragments thereof, as disclosed in US 2013/0309250 and WO2007/005874, the entire disclosures of which are hereby incorporated by reference. In illustrative embodiments, 13G4 or an antigen-binding fragment thereof for use in the methods provided herein comprises a heavy chain variable region comprising the amino acid sequence of SEQ ID NO: 122 and/or a light chain variable region comprising the amino acid sequence of SEQ ID NO: 123.

In an embodiment, the targeting moiety comprises a derivative of the anti-PD-L1 antibody 1E12, or fragments thereof, as disclosed in US 2014/0044738, the entire disclosures of which are hereby incorporated by reference. In illustrative embodiments, 1E12 or an antigen-binding fragment thereof for use in the methods provided herein comprises a heavy chain variable region comprising the amino acid sequence of SEQ ID NO: 124 and/or a light chain variable region comprising the amino acid sequence of SEQ ID NO: 125.

In an embodiment, the targeting moiety comprises a derivative of the anti-PD-L1 antibody 1F4, or fragments thereof, as disclosed in US 2014/0044738, the entire disclosures of which are hereby incorporated by reference. In illustrative embodiments, 1F4 or an antigen-binding fragment thereof for use in the methods provided herein comprises a heavy chain variable region comprising the amino acid sequence of SEQ ID NO: 126 and/or a light chain variable region comprising the amino acid sequence of SEQ ID NO: 127.

In an embodiment, the targeting moiety comprises a derivative of the anti-PD-L1 antibody 2G11, or fragments thereof, as disclosed in US 2014/0044738, the entire disclosures of which are hereby incorporated by reference. In illustrative embodiments, 2G11 or an antigen-binding fragment thereof for use in the methods provided herein comprises a heavy chain variable region comprising the amino acid sequence of SEQ ID NO: 128 and/or a light chain variable region comprising the amino acid sequence of SEQ ID NO: 129.

In an embodiment, the targeting moiety comprises a derivative of the anti-PD-L1 antibody 3B6, or fragments thereof, as disclosed in US 2014/0044738, the entire disclosures of which are hereby incorporated by reference. In illustrative embodiments, 3B6 or an antigen-binding fragment thereof for use in the methods provided herein comprises a heavy chain variable region comprising the amino acid sequence of SEQ ID NO: 130 and/or a light chain variable region comprising the amino acid sequence of SEQ ID NO: 131.

In an embodiment, the targeting moiety comprises a derivative of the anti-PD-L1 antibody 3D10, or fragments thereof, as disclosed in US 2014/0044738 and WO2012/145493, the entire disclosures of which are hereby incorporated by reference. In illustrative embodiments, 3D10 or an antigen-binding fragment thereof for use in the methods provided herein comprises a heavy chain variable region comprising the amino acid sequence of SEQ ID NO: 132 and/or a light chain variable region comprising the amino acid sequence of SEQ ID NO: 133.

In an embodiment, the targeting moiety comprises a derivative of any one of the anti-PD-L1 antibodies disclosed in US2011/0271358 and WO2010/036959, the entire contents of which are hereby incorporated by reference. In illustrative embodiments, the antibody or an antigen-binding fragment thereof for use in the methods provided herein comprises a heavy chain comprising an amino acid sequence selected from SEQ ID NOs: 34-38 of US2011/0271358:
SEQ ID NO: 34 of US2011/0271358 (SEQ ID NO: 134);
SEQ ID NO: 35 of US2011/0271358 (SEQ ID NO: 135);
SEQ ID NO: 36 of US2011/0271358 (SEQ ID NO: 136);
SEQ ID NO: 37 of US2011/0271358 (SEQ ID NO: 137);
SEQ ID NO: 38 of US2011/0271358 (SEQ ID NO: 138);
and/or a light chain comprising an amino acid sequence selected from SEQ ID NOs: 39-42 of US2011/0271358:
SEQ ID NO: 39 of US2011/0271358 (SEQ ID NO: 139);
SEQ ID NO: 40 of US2011/0271358 (SEQ ID NO: 140);
SEQ ID NO: 41 of US2011/0271358 (SEQ ID NO: 141);
SEQ ID NO: 42 of US2011/0271358 (SEQ ID NO: 142):

In an embodiment, the targeting moiety comprises a derivative of the anti-PD-L1 antibody 2.7A4, or fragments thereof, as disclosed in WO 2011/066389, U.S. Pat. No. 8,779,108, and US2014/0356353, the entire disclosures of which are hereby incorporated by reference. In illustrative embodiments, 2.7A4 or an antigen-binding fragment thereof for use in the methods provided herein comprises a heavy chain variable region comprising the amino acid sequence of: SEQ ID NO: 2 of WO 2011/066389 (SEQ ID NO: 143) and/or a light chain variable region comprising the amino acid sequence of SEQ ID NO: 7 of WO 2011/066389 (SEQ ID NO: 144).

In an embodiment, the targeting moiety comprises a derivative of the anti-PD-L1 antibody 2.9D10, or fragments thereof, as disclosed in WO 2011/066389, U.S. Pat. No. 8,779,108, and US2014/0356353, the entire disclosures of which are hereby incorporated by reference. In illustrative embodiments, 2.9D10 or an antigen-binding fragment thereof for use in the methods provided herein comprises a heavy chain variable region comprising the amino acid sequence of: SEQ ID NO: 12 of WO 2011/066389 (SEQ ID NO: 145) and/or a light chain variable region comprising the amino acid sequence of SEQ ID NO: 17 of WO 2011/066389 (SEQ ID NO: 146).

In an embodiment, the targeting moiety comprises a derivative of the anti-PD-L1 antibody 2.14H9, or fragments thereof, as disclosed in WO 2011/066389, U.S. Pat. No. 8,779,108, and US2014/0356353, the entire disclosures of which are hereby incorporated by reference. In illustrative embodiments, 2.14H9 or an antigen-binding fragment thereof for use in the methods provided herein comprises a heavy chain variable region comprising the amino acid sequence of SEQ ID NO: 22 of WO 2011/066389 (SEQ ID NO: 101) and/or a light chain variable region comprising the amino acid sequence of SEQ ID NO: 27 of WO 2011/066389 (SEQ ID NO: 147).

In an embodiment, the targeting moiety comprises a derivative of the anti-PD-L1 antibody 2.20A8, or fragments thereof, as disclosed in WO 2011/066389, U.S. Pat. No. 8,779,108, and US2014/0356353, the entire disclosures of which are hereby incorporated by reference. In illustrative embodiments, 2.20A8 or an antigen-binding fragment thereof for use in the methods provided herein comprises a heavy chain variable region comprising the amino acid sequence of SEQ ID NO: 32 of WO 2011/066389 (SEQ ID NO: 148) and/or a light chain variable region comprising the amino acid sequence of SEQ ID NO: 37 of WO 2011/066389 (SEQ ID NO: 149).

In an embodiment, the targeting moiety comprises a derivative of the anti-PD-L1 antibody 3.15G8, or fragments thereof, as disclosed in WO 2011/066389, U.S. Pat. No. 8,779,108, and US2014/0356353, the entire disclosures of which are hereby incorporated by reference. In illustrative embodiments, 3.15G8 or an antigen-binding fragment thereof for use in the methods provided herein comprises a heavy chain variable region comprising the amino acid sequence of SEQ ID NO: 42 of WO 2011/066389 (SEQ ID NO: 908) and/or a light chain variable region comprising the amino acid sequence of SEQ ID NO: 47 of WO 2011/066389 (SEQ ID NO: 150).

In an embodiment, the targeting moiety comprises a derivative of the anti-PD-L1 antibody 3.18G1, or fragments thereof, as disclosed in WO 2011/066389, U.S. Pat. No. 8,779,108, and US2014/0356353, the entire disclosures of which are hereby incorporated by reference. In illustrative embodiments, 3.18G1 or an antigen-binding fragment thereof for use in the methods provided herein comprises a heavy chain variable region comprising the amino acid sequence of SEQ ID NO: 52 of WO 2011/066389 (SEQ ID NO: 151) and/or a light chain variable region comprising the amino acid sequence of SEQ ID NO: 57 of WO 2011/066389 (SEQ ID NO: 152).

In an embodiment, the targeting moiety comprises a derivative of the anti-PD-L1 antibody 2.7A4OPT, or fragments thereof, as disclosed in WO 2011/066389, U.S. Pat. No. 8,779,108, and US2014/0356353, and US2014/0356353, the entire disclosures of which are hereby incorporated by reference. In illustrative embodiments, 2.7A4OPT or an antigen-binding fragment thereof for use in the methods provided herein comprises a heavy chain variable region comprising the amino acid sequence of SEQ ID NO: 62 of WO 2011/066389 (SEQ ID NO: 153) and/or a light chain variable region comprising the amino acid sequence of SEQ ID NO: 67 of WO 2011/066389 (SEQ ID NO: 154).

In an embodiment, the targeting moiety comprises a derivative of the anti-PD-L1 antibody 2.14H9OPT, or fragments thereof, as disclosed in WO 2011/066389, U.S. Pat. No. 8,779,108, and US2014/0356353, the entire disclosures of which are hereby incorporated by reference. In illustrative embodiments, 2.14H9OPT or an antigen-binding fragment thereof for use in the methods provided herein comprises a heavy chain variable region comprising the amino acid sequence of SEQ ID NO: 72 of WO 2011/066389 (SEQ ID NO: 101) and/or a light chain variable region comprising the amino acid sequence of SEQ ID NO: 77 of WO 2011/066389 (SEQ ID NO: 102).

In an embodiment, the targeting moiety comprises a derivative of any one of the anti-PD-L1 antibodies disclosed in WO2016/061142, the entire contents of which are hereby incorporated by reference. In illustrative embodiments, the antibody or an antigen-binding fragment thereof for use in the methods provided herein comprises a derivative of a heavy chain comprising an amino acid sequence selected from SEQ ID NOs: 18, 30, 38, 46, 50, 54, 62, 70, and 78 of WO2016/061142: SEQ ID NO: 18 of WO2016/061142 (SEQ ID NO: 155); SEQ ID NO: 30 of WO2016/061142 (SEQ ID NO: 156); SEQ ID NO: 38 of WO2016/061142 (SEQ ID NO: 157); SEQ ID NO: 46 of WO2016/061142 (SEQ ID NO: 158); SEQ ID NO: 50 of WO2016/061142 (SEQ ID NO: 159); SEQ ID NO: 54 of WO2016/061142 (SEQ ID NO: 160); SEQ ID NO: 62 of WO2016/061142: (SEQ ID NO: 161); SEQ ID NO: 70 of WO2016/061142 (SEQ ID NO: 162); SEQ ID NO: 78 of WO2016/061142 (SEQ ID NO: 163); and/or a derivative of a light chain comprising an amino acid sequence selected from SEQ ID NOs: 22, 26, 34, 42, 58, 66, 74, 82, and 86 of WO2016/061142: SEQ ID NO: 22 of WO2016/061142 (SEQ ID NO: 164); SEQ ID NO: 26 of WO2016/061142 (SEQ ID NO: 165); SEQ ID NO: 34 of WO2016/061142 (SEQ ID NO: 166); SEQ ID NO: 42 of WO2016/061142 (SEQ ID NO: 167); SEQ ID NO: 58 of WO2016/061142 (SEQ ID NO: 168); SEQ ID NO: 66 of WO2016/061142 (SEQ ID NO: 169); SEQ ID NO: 74 of WO2016/061142 (SEQ ID NO: 170); SEQ ID NO: 82 of WO2016/061142 (SEQ ID NO: 171) SEQ ID NO: 86 of WO2016/061142 (SEQ ID NO: 172).

In an embodiment, the targeting moiety comprises a derivative of any one of the anti-PD-L1 antibodies disclosed in WO2016/022630, the entire contents of which are hereby incorporated by reference. In illustrative embodiments, the antibody or an antigen-binding fragment thereof for use in the methods provided herein comprises a derivative of a heavy chain comprising an amino acid sequence selected from SEQ ID NOs: 2, 6, 10, 14, 18, 22, 26, 30, 34, 38, 42, and 46 of WO2016/022630: SEQ ID NO: 2 of WO2016/022630 (SEQ ID NO: 173); SEQ ID NO: 6 of WO2016/022630 (SEQ ID NO: 174); SEQ ID NO: 10 of WO2016/022630 (SEQ ID NO: 175); SEQ ID NO: 14 of WO2016/022630 (SEQ ID NO: 176); SEQ ID NO: 18 of WO2016/022630 (SEQ ID NO: 177); SEQ ID NO: 22 of WO2016/022630 (SEQ ID NO: 178); SEQ ID NO: 26 of WO2016/022630 (SEQ ID NO: 179); SEQ ID NO: 30 of WO2016/022630 (SEQ ID NO: 180); SEQ ID NO: 34 of WO2016/022630 (SEQ ID NO: 181); SEQ ID NO: 38 of WO2016/022630 (SEQ ID NO: 182); SEQ ID NO: 42 of WO2016/022630 (SEQ ID NO: 183); SEQ ID NO: 46 of WO2016/022630 (SEQ ID NO: 184); and/or a derivative of a light chain comprising an amino acid sequence selected from SEQ ID NOs: 4, 8, 12, 16, 20, 24, 28, 32, 36, 40, 44, and 48 of WO2016/022630: SEQ ID NO: 4 of WO2016/022630 (SEQ ID NO: 185); SEQ ID NO: 8 of WO2016/022630 (SEQ ID NO: 186); SEQ ID NO: 12 of WO2016/022630 (SEQ ID NO: 187); SEQ ID NO: 16 of WO2016/022630 (SEQ ID NO: 188); SEQ ID NO: 20 of WO2016/022630 (SEQ ID NO: 189); SEQ ID NO: 24 of WO2016/022630 (SEQ ID NO: 190); SEQ ID NO: 28 of WO2016/022630 (SEQ ID NO: 191); SEQ ID NO: 32 of WO2016/022630 (SEQ ID NO: 192); SEQ ID NO: 36 of WO2016/022630 (SEQ ID NO: 193); SEQ ID NO: 40 of WO2016/022630 (SEQ ID NO: 194); SEQ ID NO: 44 of WO2016/022630 (SEQ ID NO: 195); SEQ ID NO: 48 of WO2016/022630 (SEQ ID NO: 196).

In an embodiment, the targeting moiety comprises a derivative of any one of the anti-PD-L1 antibodies disclosed in WO2015/112900, the entire contents of which are hereby incorporated by reference. In illustrative embodiments, the antibody or an antigen-binding fragment thereof for use in the methods provided herein comprises a derivative of a heavy chain comprising an amino acid sequence selected from SEQ ID NOs: 38, 50, 82, and 86 of WO 2015/112900: SEQ ID NO: 38 of WO2015/112900 (SEQ ID NO: 197);

SEQ ID NO: 50 of WO 2015/112900 (SEQ ID NO: 198); SEQ ID NO: 82 of WO 2015/112900 (SEQ ID NO: 199); SEQ ID NO: 86 of WO 2015/112900 (SEQ ID NO: 200); and/or a derivative of a light chain comprising an amino acid sequence selected from SEQ ID NOs: 42, 46, 54, 58, 62, 66, 70, 74, and 78 of WO 2015/112900: SEQ ID NO: 42 of WO2015/112900 (SEQ ID NO: 201); SEQ ID NO: 46 of WO 2015/112900 (SEQ ID NO: 202); SEQ ID NO: 54 of WO 2015/112900 (SEQ ID NO: 203); SEQ ID NO: 58 of WO 2015/112900 (SEQ ID NO: 204); SEQ ID NO: 62 of WO 2015/112900 (SEQ ID NO: 205); SEQ ID NO: 66 of WO 2015/112900 (SEQ ID NO: 206); SEQ ID NO: 70 of WO 2015/112900 (SEQ ID NO: 207); SEQ ID NO: 74 of WO 2015/112900 (SEQ ID NO: 208); SEQ ID NO: 78 of WO 2015/112900 (SEQ ID NO: 209).

In an embodiment, the targeting moiety comprises a derivative of any one of the anti-PD-L1 antibodies disclosed in WO 2010/077634 and U.S. Pat. No. 8,217,149, the entire disclosures of which are hereby incorporated by reference. In illustrative embodiments, the anti-PD-L1 antibody or an antigen-binding fragment thereof for use in the methods provided herein comprises a derivative of a heavy chain region comprising the amino acid sequence of SEQ ID NO: 20 of WO 2010/077634 (SEQ ID NO: 210) and/or a derivative of a light chain variable region comprising the amino acid sequence of SEQ ID NO: 21 of WO 2010/077634 (SEQ ID NO: 211).

In an embodiment, the targeting moiety comprises a derivative of any one of the anti-PD-L1 antibodies obtainable from the hybridoma accessible under CNCM deposit numbers CNCM 1-4122, CNCM 1-4080 and CNCM 1-4081 as disclosed in US 20120039906, the entire disclosures of which are hereby incorporated by reference.

In an embodiment, the targeting moiety comprises a derivative of a VHH directed against PD-L1 as disclosed, for example, in U.S. Pat. No. 8,907,065 and WO 2008/071447, the entire disclosures of which are hereby incorporated by reference. In illustrative embodiments, the VHHs against PD-L1 comprise SEQ ID NOs: 394-399 of U.S. Pat. No. 8,907,065: SEQ ID NO: 394 of U.S. Pat. No. 8,907,065 (SEQ ID NO: 212); SEQ ID NO: 395 of U.S. Pat. No. 8,907,065 (SEQ ID NO: 213); SEQ ID NO: 396 of U.S. Pat. No. 8,907,065 (SEQ ID NO: 214); SEQ ID NO: 397 of U.S. Pat. No. 8,907,065 (SEQ ID NO: 215); SEQ ID NO: 398 of U.S. Pat. No. 8,907,065 (SEQ ID NO: 216); SEQ ID NO: 399 of U.S. Pat. No. 8,907,065 (SEQ ID NO: 217).

In various embodiments, the present chimeric protein has one or more targeting moieties directed against PD-L2. In some embodiments, the chimeric protein has one or more targeting moieties which selectively bind a PD-L2 polypeptide. In some embodiments, the chimeric protein comprises one or more antibodies, antibody derivatives or formats, peptides or polypeptides, or fusion proteins that selectively bind a PD-L2 polypeptide. In various embodiments, the present chimeric protein comprises a first targeting moiety that binds to PD-L2 with low affinity.

In an embodiment, the targeting moiety comprises a derivative of a VHH directed against PD-L2 as disclosed, for example, in U.S. Pat. No. 8,907,065 and WO 2008/071447, the entire disclosures of which are hereby incorporated by reference. In illustrative embodiments, the VHHs against PD-L2 comprise SEQ ID NOs: 449-455 of U.S. Pat. No. 8,907,065: SEQ ID NO: 449 of U.S. Pat. No. 8,907,065 (SEQ ID NO: 218); SEQ ID NO: 450 of U.S. Pat. No. 8,907,065 (SEQ ID NO: 219); SEQ ID NO: 451 of U.S. Pat. No. 8,907,065 (SEQ ID NO: 220); SEQ ID NO: 452 of U.S. Pat. No. 8,907,065 (SEQ ID NO: 221); SEQ ID NO: 453 of U.S. Pat. No. 8,907,065 (SEQ ID NO: 222); SEQ ID NO: 454 of U.S. Pat. No. 8,907,065 (SEQ ID NO: 223); SEQ ID NO: 455 of U.S. Pat. No. 8,907,065 (SEQ ID NO: 224).

In an embodiment, the targeting moiety comprises a derivative of any one of the anti-PD-L2 antibodies disclosed in US2011/0271358 and WO2010/036959, the entire contents of which are hereby incorporated by reference. In illustrative embodiments, the antibody or an antigen-binding fragment thereof for use in the methods provided herein comprises a derivative of a heavy chain comprising an amino acid sequence selected from SEQ ID NOs: 43-47 of US2011/0271358: SEQ ID NO: 43 of US2011/0271358 (SEQ ID NO: 225); SEQ ID NO: 44 of US2011/0271358 (SEQ ID NO: 226); SEQ ID NO: 45 of US2011/0271358 (SEQ ID NO: 227); SEQ ID NO: 46 of US2011/0271358 (SEQ ID NO: 228); SEQ ID NO: 47 of US2011/0271358 (SEQ ID NO: 229); and/or a derivative of a light chain comprising an amino acid sequence selected from SEQ ID NOs: 48-51 of US2011/0271358: SEQ ID NO: 48 of US2011/0271358 (SEQ ID NO: 230); SEQ ID NO: 49 of US2011/0271358 (SEQ ID NO: 231); SEQ ID NO: 50 of US2011/0271358 (SEQ ID NO: 232); SEQ ID NO: 51 of US2011/0271358 (SEQ ID NO: 233).

In various embodiments, the targeting moieties of the invention may comprise a sequence that targets PD-1, PD-L1, and/or PD-L2 which is at least about 60%, at least about 61%, at least about 62%, at least about 63%, at least about 64%, at least about 65%, at least about 66%, at least about 67%, at least about 68%, at least about 69%, at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or 100% identical to any of the sequences disclosed herein (e.g., about 60%, or about 61%, or about 62%, or about 63%, or about 64%, or about 65%, or about 66%, or about 67%, or about 68%, or about 69%, or about 70%, or about 71%, or about 72%, or about 73%, or about 74%, or about 75%, or about 76%, or about 77%, or about 78%, or about 79%, or about 80%, or about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, about 99% or about 100% sequence identity with any of the sequences disclosed herein).

In various embodiments, the targeting moieties of the invention may comprise any combination of heavy chain, light chain, heavy chain variable region, light chain variable region, complementarity determining region (CDR), and framework region sequences that target PD-1, PD-L1, and/or PD-L2 as disclosed herein.

Additional antibodies, antibody derivatives or formats, peptides or polypeptides, or fusion proteins that selectively bind or target PD-1, PD-L1 and/or PD-L2 are disclosed in WO 2011/066389, US 2008/0025980, US 2013/0034559, U.S. Pat. No. 8,779,108, US 2014/0356353, U.S. Pat. No. 8,609,089, US 2010/028330, US 2012/0114649, WO 2010/027827, WO 2011/066342, U.S. Pat. No. 8,907,065, WO 2016/062722, WO 2009/101611, WO2010/027827, WO 2011/066342, WO 2007/005874, WO 2001/014556, US2011/0271358, WO 2010/036959, WO 2010/077634, U.S. Pat. No. 8,217,149, US 2012/0039906, WO 2012/145493, US 2011/0318373, U.S. Pat. No. 8,779,108, US 20140044738, WO 2009/089149, WO 2007/00587, WO 2016061142, WO 2016,02263, WO 2010/077634, and WO 2015/112900, the entire disclosures of which are hereby incorporated by reference.

In one embodiment, the present chimeric protein has (i) a targeting moiety directed against a checkpoint marker on a T cell, for example, PD-1 and (ii) a targeting moiety directed against a tumor cell, for example, PD-L1 or PD-L2, along with any of the modified (e.g., mutant) signaling agents described herein (e.g., modified IFN-γ). In an embodiment, the present chimeric protein has a targeting moiety directed against PD-1 on T cells and a second targeting moiety directed against PD-L1 on tumor cells. In another embodiment, the present chimeric protein has a targeting moiety directed against PD-1 on T cells and a second targeting moiety directed against PD-L2 on tumor cells.

In one embodiment, the present chimeric protein has (i) a targeting moiety directed against a T cell, for example, mediated by targeting to CD8 and (ii) a targeting moiety is directed against a tumor cell, along with any of the modified (e.g., mutant) signaling agents described herein (e.g., modified IFN-γ). In an embodiment, the present chimeric protein has a targeting moiety directed against CD8 on T cells and a second targeting moiety directed against PD-L1 or PD-L2 on tumor cells.

In one embodiment, the present chimeric protein has (i) a targeting moiety directed against a T cell, for example, mediated by targeting to CD4 and (ii) a targeting moiety is directed against a tumor cell, along with any of the modified (e.g., mutant) signaling agents described herein (e.g., modified IFN-γ). In an embodiment, the present chimeric protein has a targeting moiety directed against CD4 on T cells and a second targeting moiety directed against PD-L1 or PD-L2 on tumor cells.

In one embodiment, the present chimeric protein has (i) a targeting moiety directed against a T cell, for example, mediated by targeting to CD3, CXCR3, CCR4, CCR9, CD70, CD103, or one or more immune checkpoint markers and (ii) a targeting moiety is directed against a tumor cell, along with any of the modified (e.g., mutant) signaling agents described herein (e.g., modified IFN-γ). In an embodiment, the present chimeric protein has a targeting moiety directed against CD3 on T cells and a second targeting moiety directed against PD-L1 or PD-L2 on tumor cells.

In one embodiment, the present chimeric protein has (i) a targeting moiety directed against a T cell, for example, mediated by targeting to PD-1 and (ii) a targeting moiety is directed against a tumor cell, along with any of the modified (e.g., mutant) signaling agents described herein (e.g., modified IFN-γ).

By way of non-limiting example, in various embodiments, the present chimeric protein has (i) a targeting moiety directed against a B cell, for example, mediated by targeting to CD10, CD19, CD20, CD21, CD22, CD23, CD24, CD37, CD38, CD39, CD40, CD70, CD72, CD73, CD74, CDw75, CDw76, CD77, CD78, CD79a/b, CD80, CD81, CD82, CD83, CD84, CD85, CD86, CD89, CD98, CD126, CD127, CDw130, CD138, CDw150 and B-cell maturation antigen (BCMA); and (ii) a targeting moiety is directed against a tumor cell, along with any of the modified (e.g., mutant) signaling agents described herein (e.g., modified IFN-γ).

In one embodiment, the present chimeric protein has (i) a targeting moiety directed against a B cell, for example, mediated by targeting to CD19, CD20 or CD70 and (ii) a targeting moiety is directed against a tumor cell, along with any of the modified (e.g., mutant) signaling agents described herein (e.g., modified IFN-γ).

In one embodiment, the present chimeric protein has (i) a targeting moiety directed against a B cell, for example, mediated by targeting to CD20 and (ii) a targeting moiety is directed against a tumor cell, along with any of the modified (e.g., mutant) signaling agents described herein (e.g., modified IFN-γ). In an embodiment, the present chimeric protein has a targeting moiety directed against CD20 on B cells and a second targeting moiety directed against PD-L1 or PD-L2 on tumor cells.

By way of non-limiting example, in various embodiments, the present chimeric protein has (i) a targeting moiety directed against a NK cell, for example, mediated by targeting to 2B4/SLAMF4, KIR2DS4, CD155/PVR, KIR3DL1, CD94, LMIR1/CD300A, CD69, LMIR2/CD300c, CRACC/SLAMF7, LMIR3/CD300LF, DNAM-1, LMIR5/CD300LB, Fc-epsilon RII, LMIR6/CD300LE, Fc-γ RI/CD64, MICA, Fc-γ RIIB/CD32b, MICB, Fc-γ RIIC/CD32c, MULT-1, Fc-γ RIIA/CD32a, Nectin-2/CD112, Fc-γ RIII/CD16, NKG2A, FcRH1/IRTA5, NKG2C, FcRH2/IRTA4, NKG2D, FcRH4/IRTA1, NKp30, FcRH5/IRTA2, NKp44, Fc-Receptor-like 3/CD16-2, NKp46/NCR1, NKp80/KLRF1, NTB-A/SLAMF6, Rae-1, Rae-1 α, Rae-1 β, Rae-1 delta, H60, Rae-1 epsilon, ILT2/CD85j, Rae-1 γ, ILT3/CD85k, TREM-1, ILT4/CD85d, TREM-2, ILT5/CD85a, TREM-3, KIR/CD158, TREML1/TLT-1, KIR2DL1, ULBP-1, KIR2DL3, ULBP-2, KIR2DL4/CD158d, or ULBP-3; and (ii) a targeting moiety is directed against a tumor cell, along with any of the modified (e.g., mutant) signaling agents described herein (e.g., modified IFN-γ).

In one embodiment, the present chimeric protein has (i) a targeting moiety directed against a NK cell, for example, mediated by targeting to Kir1alpha, DNAM-1 or CD64 and (ii) a targeting moiety is directed against a tumor cell, along with any of the modified (e.g., mutant) signaling agents described herein (e.g., modified IFN-γ).

In one embodiment, the present chimeric protein has (i) a targeting moiety directed against a NK cell, for example, mediated by targeting to KIR1 and (ii) a targeting moiety is directed against a tumor cell, along with any of the modified (e.g., mutant) signaling agents described herein (e.g., modified IFN-γ). In an embodiment, the present chimeric protein has a targeting moiety directed against KIR1 on NK cells and a second targeting moiety directed against PD-L1 or PD-L2 on tumor cells.

In one embodiment, the present chimeric protein has (i) a targeting moiety directed against a NK cell, for example, mediated by targeting to TIGIT or KIR1 and (ii) a targeting moiety is directed against a tumor cell, along with any of the modified (e.g., mutant) signaling agents described herein (e.g., modified IFN-γ). In an embodiment, the present chimeric protein has a targeting moiety directed against TIGIT on NK cells and a second targeting moiety directed against PD-L1 or PD-L2 on tumor cells.

By way of non-limiting example, in various embodiments, the present chimeric protein has (i) a targeting moiety directed against a dendritic cell, for example, mediated by targeting to CLEC-9A, XCR1, RANK, CD36/SRB3, LOX-1/SR-E1, CD68, MARCO, CD163, SR-A1/MSR, CD5L, SREC-1, CL-PI/COLEC12, SREC-II, LIMPIISRB2, RP105, TLR4, TLR1, TLR5, TLR2, TLR6, TLR3, TLR9, 4-IBB Ligand/TNFSF9, IL-12/IL-23 p40, 4-Amino-1,8-naphthalimide, ILT2/CD85j, CCL21/6Ckine, ILT3/CD85k, 8-oxo-dG, ILT4/CD85d, 8D6A, ILT5/CD85a, A2B5, lutegrin α 4/CD49d, Aag, Integrin β 2/CD18, AMICA, Langerin, B7-2/CD86, Leukotriene B4 RI, B7-H3, LMIR1/CD300A, BLAME/SLAMF8, LMIR2/CD300c, Clq R1/CD93, LMIR3/CD300LF, CCR6, LMIR5/CD300LB CCR7, LMIR6/CD300LE, CD40/TNFRSF5, MAG/Siglec-4-a, CD43, MCAM, CD45, MD-1, CD68, MD-2, CD83, MDL-1/CLEC5A, CD84/SLAMF5, MMR, CD97, NCAMLI, CD2F-10/SLAMF9, Osteoactivin GPNMB, Chern 23, PD-L2, CLEC-1, RP105, CLEC-2, Siglec-2/CD22, CRACC/SLAMF7, Siglec-3/CD33, DC-SIGN, Siglec-5, DC-SIGNR/CD299, Siglec-6, DCAR, Siglec-7, DCIR/CLEC4A, Siglec-9, DEC-205, Siglec-10, Dectin-1/CLEC7A, Siglec-F, Dectin-2/CLEC6A, SIGNR1/CD209, DEP-1/CD148, SIGNR4, DLEC, SLAM, EMMPRIN/CD147, TCCR/WSX-1, Fc-γ R1/CD64, TLR3, Fc-γ RIIB/CD32b, TREM-1, Fc-γ RIIC/CD32c, TREM-2, Fc-γ RIIA/CD32a, TREM-3, Fc-γ RIII/CD16, TREML1/TLT-1, ICAM-2/CD102, or Vanilloid R1; and (ii) a targeting moiety that is directed against a tumor cell or immune cell, along with any of the modified (e.g., mutant) signaling agents described herein (e.g., modified IFN-γ).

In one embodiment, the present chimeric protein has (i) a targeting moiety directed against a dendritic cell, for example, mediated by targeting to CLEC-9A, DC-SIGN, CD64, CLEC4A, or DEC205 and (ii) a targeting moiety is directed against a tumor cell, along with any of the modified (e.g., mutant) signaling agents described herein (e.g., modified IFN-γ). In an embodiment, the present chimeric protein has a targeting moiety directed against CLEC9A on dendritic cells and a second targeting moiety directed against PD-L1 or PD-L2 on tumor cells.

In one embodiment, the present chimeric protein has (i) a targeting moiety directed against a dendritic cell, for example, mediated by targeting to CLEC9A and (ii) a targeting moiety is directed against a tumor cell, along with any of the modified (e.g., mutant) signaling agents described herein (e.g., modified IFN-γ). In an embodiment, the present chimeric protein has a targeting moiety directed against CLEC9A on dendritic cells and a second targeting moiety directed against PD-L1 or PD-L2 on tumor cells.

In one embodiment, the present chimeric protein has (i) a targeting moiety directed against a dendritic cell, for example, mediated by targeting to XCR1 and (ii) a targeting moiety is directed against a tumor cell, along with any of the modified (e.g., mutant) signaling agents described herein (e.g., modified IFN-γ). In an embodiment, the present chimeric protein has a targeting moiety directed against XCR1 on dendritic cells and a second targeting moiety directed against PD-L1 or PD-L2 on tumor cells.

In one embodiment, the present chimeric protein has (i) a targeting moiety directed against a dendritic cell, for example, mediated by targeting to RANK and (ii) a targeting moiety is directed against a tumor cell, along with any of the modified (e.g., mutant) signaling agents described herein (e.g., modified IFN-γ). In an embodiment, the present chimeric protein has a targeting moiety directed against RANK on dendritic cells and a second targeting moiety directed against PD-L1 or PD-L2 on tumor cells.

By way of non-limiting example, in various embodiments, the present chimeric protein has (i) a targeting moiety directed against a monocyte/macrophage, for example, mediated by targeting to SIRP1a, B7-1/CD80, ILT4/CD85d, B7-H1, ILT5/CD85a, Common β Chain, Integrin α 4/CD49d, BLAME/SLAMF8, Integrin α X/CDIIc, CCL6/C10, Integrin β 2/CD18, CD155/PVR, Integrin β 3/CD61, CD31/PECAM-1, Latexin, CD36/SR-B3, Leukotriene B4 R1, CD40/TNFRSF5, LIMPIIISR-B2, CD43, LMIR1/CD300A, CD45, LMIR2/CD300c, CD68, LMIR3/CD300LF, CD84/SLAMF5, LMIR5/CD300LB, CD97, LMIR6/CD300LE, CD163, LRP-1, CD2F-10/SLAMF9, MARCO, CRACC/SLAMF7, MD-1, ECF-L, MD-2, EMMPRIN/CD147, MGL2, Endoglin/CD105, Osteoactivin/GPNMB, Fc-γ RI/CD64, Osteopontin, Fc-γ RIIB/CD32b, PD-L2, Fc-γ RIIC/CD32c, Siglec-3/CD33, Fc-γ RIIA/CD32a, SIGNR1/CD209, Fc-γ RIII/CD16, SLAM, GM-CSF R α, TCCR/WSX-1, ICAM-2/CD102, TLR3, IFN-γ RI, TLR4, IFN-gannna R2, TREM-I, IL-I RII, TREM-2, ILT2/CD85j, TREM-3, ILT3/CD85k, TREML1/TLT-1, 2B4/SLAMF 4, IL-10 R α, ALCAM, IL-10 R β, Aminopeptidase-N/ANPEP, ILT2/CD85j, Common β Chain, ILT3/CD85k, Clq R1/CD93, ILT4/CD85d, CCR1, ILT5/CD85a, CCR2, CD206, Integrin α 4/CD49d, CCR5, Integrin α M/CDII b, CCR8, Integrin α X/CDIIc, CD155/PVR, Integrin β 2/CD18, CD14, Integrin β 3/CD61, CD36/SR-B3, LAIR1, CD43, LAIR2, CD45, Leukotriene B4-R1, CD68, LIMPII-ISR-B2, CD84/SLAMF5, LMIR1/CD300A, CD97, LMIR2/CD300c, CD163, LMIR3/CD300LF, Coagulation Factor III/Tissue Factor, LMIR5/CD300LB, CX3CR1, CX3CL1, LMIR6/CD300LE, CXCR4, LRP-1, CXCR6, M-CSF R, DEP-1/CD148, DNAM-1, MD-2, EMMPRIN/CD147, MMR, Endoglin/CD105, NCAM-L1, Fc-γ RI/CD64, PSGL-1, Fc-γ RIIICD16, RP105, G-CSF R, L-Selectin, GM-CSF R α, Siglec-3/CD33, HVEM/TNFRSF14, SLAM, ICAM-1/CD54, TCCR/WSX-1, ICAM-2/CD102, TREM-I, IL-6 R, TREM-2, CXCRI/IL-8 RA, TREM-3, or TREMLI/TLT-1; and (ii) a targeting moiety is directed against a tumor cell, along with any of the modified (e.g., mutant) signaling agents described herein (e.g., modified IFN-γ).

In one embodiment, the present chimeric protein has (i) a targeting moiety directed against a monocyte/macrophage, for example, mediated by targeting to B7-H1, CD31/PECAM-1, CD163, CCR2, or Macrophage Mannose Receptor CD206 and (ii) a targeting moiety is directed against a tumor cell, along with any of the modified (e.g., mutant) signaling agents described herein (e.g., modified IFN-γ).

In one embodiment, the present chimeric protein has (i) a targeting moiety directed against a monocyte/macrophage, for example, mediated by targeting to SIRP1a and (ii) a targeting moiety is directed against a tumor cell, along with any of the modified (e.g., mutant) signaling agents described herein (e.g., modified IFN-γ). In an embodiment, the present chimeric protein has a targeting moiety directed against SIRP1a on macrophage cells and a second targeting moiety directed against PD-L1 or PD-L2 on tumor cells.

In various embodiments, the present chimeric protein has one or more targeting moieties directed against a checkpoint marker, e.g., one or more of PD-1/PD-L1 or PD-L2, CD28/CD80 or CD86, CTLA4/CD80 or CD86, ICOS/ICOSL or B7RP1, BTLA/HVEM, KIR, LAG3, CD137/CD137L, OX40/OX40L, CD27, CD40L, TIM3/Gal9, and A2aR.

In some embodiments, the present chimeric protein comprises two or more targeting moieties directed to the same or different immune cells. In some embodiments, the present chimeric protein has (i) one or more targeting moieties directed against an immune cell selected from a T cell, a B cell, a dendritic cell, a macrophage, a NK cell, or subsets thereof and (ii) one or more targeting moieties directed against either the same or another immune cell selected from a T cell, a B cell, a dendritic cell, a macrophage, a NK cell, or subsets thereof, along with any of the modified (e.g., mutant) signaling agents described herein (e.g., modified IFN-γ).

In one embodiment, the present chimeric protein comprises one or more targeting moieties directed against a T cell and one or more targeting moieties directed against the same or another T cell. In one embodiment, the present chimeric protein comprises one or more targeting moieties directed against a T cell and one or more targeting moieties directed against a B cell. In one embodiment, the present chimeric protein comprises one or more targeting moieties directed against a T cell and one or more targeting moieties directed against a dendritic cell. In one embodiment, the present chimeric protein comprises one or more targeting moieties against a T cell and one or more targeting moieties directed against a macrophage. In one embodiment, the present chimeric protein comprises one or more targeting moieties against a T cell and one or more targeting moieties directed against a NK cell. For example, in an illustrative embodiment, the chimeric protein may include a targeting moiety against CD8 and a targeting moiety against Clec9A. In another illustrative embodiment, the chimeric protein may include a targeting moiety against CD8 and a targeting moiety against CD3. In another illustrative embodiment, the chimeric protein may include a targeting moiety against CD8 and a targeting moiety against PD-1.

In one embodiment, the present chimeric protein comprises one or more targeting moieties directed against a B cell and one or more targeting moieties directed against the same or another B cell. In one embodiment, the present chimeric protein comprises one or more targeting moieties directed against a B cell and one or more targeting moieties directed against a T cell. In one embodiment, the present chimeric protein comprises one or more targeting moieties directed against a B cell and one or more targeting moieties directed against a dendritic cell. In one embodiment, the present chimeric protein comprises one or more targeting moieties against a B cell and one or more targeting moieties directed against a macrophage. In one embodiment, the present chimeric protein comprises one or more targeting moieties against a B cell and one or more targeting moieties directed against a NK cell.

In one embodiment, the present chimeric protein comprises one or more targeting moieties directed against a dendritic cell and one or more targeting moieties directed against the same or another dendritic cell. In one embodiment, the present chimeric protein comprises one or more targeting moieties directed against a dendritic cell and one or more targeting moieties directed against a T cell. In one embodiment, the present chimeric protein comprises one or more targeting moieties directed against a dendritic cell and one or more targeting moieties directed against a B cell. In one embodiment, the present chimeric protein comprises one or more targeting moieties against a dendritic cell and one or more targeting moieties directed against a macrophage. In one embodiment, the present chimeric protein comprises one or more targeting moieties against a dendritic cell and one or more targeting moieties directed against a NK cell.

In one embodiment, the present chimeric protein comprises one or more targeting moieties directed against a macrophage and one or more targeting moieties directed against the same or another macrophage. In one embodiment, the present chimeric protein comprises one or more targeting moieties directed against a macrophage and one or more targeting moieties directed against a T cell. In one embodiment, the present chimeric protein comprises one or more targeting moieties directed against a macrophage and one or more targeting moieties directed against a B cell. In one embodiment, the present chimeric protein comprises one or more targeting moieties against a macrophage and one or more targeting moieties directed against a dendritic cell. In one embodiment, the present chimeric protein comprises one or more targeting moieties against a macrophage and one or more targeting moieties directed against a NK cell.

In one embodiment, the present chimeric protein comprises one or more targeting moieties directed against an NK cell and one or more targeting moieties directed against the same or another NK cell. In one embodiment, the present chimeric protein comprises one or more targeting moieties directed against an NK cell and one or more targeting moieties directed against a T cell. In one embodiment, the present chimeric protein comprises one or more targeting moieties directed against an NK cell and one or more targeting moieties directed against a B cell. In one embodiment, the present chimeric protein comprises one or more targeting moieties against an NK cell and one or more targeting moieties directed against a macrophage. In one embodiment, the present chimeric protein comprises one or more targeting moieties against an NK cell and one or more targeting moieties directed against a dendritic cell.

In one embodiment, the present chimeric protein comprises a targeting moiety directed against a tumor cell and a second targeting moiety directed against the same or a different tumor cell. In such embodiments, the targeting moieties may bind to any of the tumor antigens described herein.

In various embodiments, chimeric constructs are constructed as described in WO 2013/107791, the entire contents of which are hereby incorporated by reference, see EXAMPLES Materials & Methods and Example 1.

In various embodiments, functional characterization of the chimeric constructs is undertaken as in Examples 2-10 of WO 2013/107791, the entire contents of which are hereby incorporated by reference.

Targeting Moiety Formats

In various embodiments, the targeting moiety of the present chimeric protein is a protein-based agent capable of specific binding, such as an antibody or derivatives thereof. In an embodiment, the targeting moiety comprises an antibody. In various embodiments, the antibody is a full-length multimeric protein that includes two heavy chains and two light chains. Each heavy chain includes one variable region (e.g., $V_H$) and at least three constant regions (e.g., $CH_1$, $CH_2$ and $CH_3$), and each light chain includes one variable region ($V_L$) and one constant region ($C_L$). The variable regions determine the specificity of the antibody. Each variable region comprises three hypervariable regions also known as complementarity determining regions (CDRs) flanked by four relatively conserved framework regions (FRs). The three CDRs, referred to as CDR1, CDR2, and CDR3, contribute to the antibody binding specificity. In some embodiments, the antibody is a chimeric antibody. In some embodiments, the antibody is a humanized antibody.

In some embodiments, the targeting moiety comprises antibody derivatives or formats. In some embodiments, the targeting moiety of the present chimeric protein is a single-domain antibody, a recombinant heavy-chain-only antibody (VHH), a single-chain antibody (scFv), a shark heavy-chain-only antibody (VNAR), a microprotein (cysteine knot protein, knottin), a DARPin; a Tetranectin; an Affibody; a Transbody; an Anticalin; an AdNectin; an Affilin; a Microbody; a peptide aptamer; an alterases; a plastic antibodies; a phylomer; a stradobodies; a maxibodies; an evibody; a fynomer, an armadillo repeat protein, a Kunitz domain, an avimer, an atrimer, a probody, an immunobody, a triomab, a troybody; a pepbody; a vaccibody, a UniBody; affimers, a DuoBody, a Fv, a Fab, a Fab', a F(ab')$_2$, a peptide mimetic molecule, or a synthetic molecule, as described in US Patent Nos. or Patent Publication Nos. U.S. Pat. No. 7,417,130, US 2004/132094, U.S. Pat. No. 5,831,012, US 2004/023334, U.S. Pat. Nos. 7,250,297, 6,818,418, US 2004/209243, U.S. Pat. Nos. 7,838,629, 7,186,524, 6,004,746, 5,475,096, US 2004/146938, US 2004/157209, U.S. Pat. Nos. 6,994,982, 6,794,144, US 2010/239633, U.S. Pat. No. 7,803,907, US 2010/119446, and/or U.S. Pat. No. 7,166,697, the contents of which are hereby incorporated by reference in their entireties. See also, Storz MAbs. 2011 May-June; 3(3): 310-317.

In one embodiment, the targeting moiety comprises a single-domain antibody, such as VHH from, for example, an organism that produces VHH antibody such as a camelid, a shark, or a designed VHH. VHHs are antibody-derived therapeutic proteins that contain the unique structural and functional properties of naturally-occurring heavy-chain antibodies. VHH technology is based on fully functional antibodies from camelids that lack light chains. These heavy-chain antibodies contain a single variable domain (VHH) and two constant domains (CH2 and CH3). VHHs are commercially available under the trademark of NANOBODY or NANOBODIES.

In an embodiment, the targeting moiety comprises a VHH. In some embodiments, the VHH is a humanized VHH or camelized VHH.

In some embodiments, the VHH comprises a fully human $V_H$ domain, e.g. a HUMABODY (Crescendo Biologics, Cambridge, UK). In some embodiments, fully human $V_H$ domain, e.g. a HUMABODY is monovalent, bivalent, or trivalent. In some embodiments, the fully human $V_H$ domain, e.g. a HUMABODY is mono- or multi-specific such as monospecific, bispecific, or trispecific. Illustrative fully human $V_H$ domains, e.g. a HUMABODIES are described in, for example, WO 2016/113555 and WO2016/113557, the entire disclosure of which is incorporated by reference.

In various embodiments, the targeting moiety of the present chimeric protein is a protein-based agent capable of specific binding to a cell receptor, such as a natural ligand for the cell receptor. In various embodiments, the cell receptor is found on one or more immune cells, which can include, without limitation, T cells, cytotoxic T lymphocytes, T helper cells, natural killer (NK) cells, natural killer T (NKT) cells, anti-tumor macrophages (e.g., M1 macrophages), B cells, dendritic cells, or subsets thereof. In some embodiments, the cell receptor is found on megakaryocytes, thrombocytes, erythrocytes, mast cells, basophils, neutrophils, eosinophils, or subsets thereof.

In some embodiments, the targeting moiety is a natural ligand such as a chemokine. Exemplary chemokines that may be included in the chimeric protein of the invention include, but are not limited to, CCL1, CCL2, CCL4, CCL5, CCL6, CCL7, CCL8, CCL9, CCL10, CCL11, CCL12, CCL13, CCL14, CCL15, CCL16, CL17, CCL18, CCL19, CCL20, CCL21, CCL22, CCL23, CCL24, CLL25, CCL26, CCL27, CXCL1, CXCL2, CXCL3, CXCL4, CXCL5, CXCL6, CXCL7, CXCL8, CXCL9, CXCL10, CXCL11, CXCL12, CXCL13, CXCL14, CXCL15, CXCL16, CXCL17, XCL1, XCL2, CX3CL1, HCC-4, and LDGF-PBP. In an illustrative embodiment, the targeting moiety may be XCL1 which is a chemokine that recognizes and binds to the dendritic cell receptor XCR1. In another illustrative embodiment, the targeting moiety is CCL1, which is a chemokine that recognizes and binds to CCR8. In another illustrative embodiment, the targeting moiety is CCL2, which is a chemokine that recognizes and binds to CCR2 or CCR9. In another illustrative embodiment, the targeting moiety is CCL3, which is a chemokine that recognizes and binds to CCR1, CCR5, or CCR9. In another illustrative embodiment, the targeting moiety is CCL4, which is a chemokine that recognizes and binds to CCR1 or CCR5 or CCR9. In another illustrative embodiment, the targeting moiety is CCL5, which is a chemokine that recognizes and binds to CCR1 or CCR3 or CCR4 or CCR5. In another illustrative embodiment, the targeting moiety is CCL6, which is a chemokine that recognizes and binds to CCR1. In another illustrative embodiment, the targeting moiety is CCL7, which is a chemokine that recognizes and binds to CCR2 or CCR9. In another illustrative embodiment, the targeting moiety is CCL8, which is a chemokine that recognizes and binds to CCR1 or CCR2 or CCR2B or CCR5 or CCR9. In another illustrative embodiment, the targeting moiety is CCL9, which is a chemokine that recognizes and binds to CCR1. In another illustrative embodiment, the targeting moiety is CCL10, which is a chemokine that recognizes and binds to CCR1. In another illustrative embodiment, the targeting moiety is CCL11, which is a chemokine that recognizes and binds to CCR2 or CCR3 or CCR5 or CCR9. In another illustrative embodiment, the targeting moiety is CCL13, which is a chemokine that recognizes and binds to CCR2 or CCR3 or CCR5 or CCR9. In another illustrative embodiment, the targeting moiety is CCL14, which is a chemokine that recognizes and binds to CCR1 or CCR9. In another illustrative embodiment, the targeting moiety is CCL15, which is a chemokine that recognizes and binds to CCR1 or CCR3. In another illustrative embodiment, the targeting moiety is CCL16, which is a chemokine that recognizes and binds to CCR1, CCR2, CCR5, or CCR8. In another illustrative embodiment, the targeting moiety is CCL17, which is a chemokine that recognizes and binds to CCR4. In another illustrative embodiment, the targeting moiety is CCL19, which is a chemokine that recognizes and binds to CCR7. In another illustrative embodiment, the targeting moiety is CCL20, which is a chemokine that recognizes and binds to CCR6. In another illustrative embodiment, the targeting moiety is CCL21, which is a chemokine that recognizes and binds to CCR7. In another illustrative embodiment, the targeting moiety is CCL22, which is a chemokine that recognizes and binds to CCR4. In another illustrative embodiment, the targeting moiety is CCL23, which is a chemokine that recognizes and binds to CCR1. In another illustrative embodiment, the targeting moiety is CCL24, which is a chemokine that recognizes and binds to CCR3. In another illustrative embodiment, the targeting moiety is CCL25, which is a chemokine that recognizes and binds to CCR9. In another illustrative embodiment, the targeting moiety is CCL26, which is a chemokine that recognizes and binds to CCR3. In another illustrative embodiment, the targeting moiety is CCL27, which is a chemokine that recognizes and binds to CCR10. In another illustrative embodiment, the targeting moiety is CCL28, which is a chemokine that recognizes and binds to CCR3 or CCR10. In another illustrative embodiment, the targeting moiety is CXCL1, which is a chemokine that recognizes and binds to CXCR1 or CXCR2. In another illustrative embodiment, the targeting moiety is CXCL2, which is a chemokine that recognizes and binds to CXCR2. In another illustrative embodiment, the targeting moiety is CXCL3, which is a chemokine that recognizes and binds to CXCR2. In another illustrative embodiment, the targeting moiety is CXCL4, which is a chemokine that recognizes and binds to CXCR3B. In another illustrative embodiment, the targeting moiety is CXCL5, which is a chemokine that recognizes and binds to CXCR2. In another illustrative embodiment, the targeting moiety is CXCL6, which is a chemokine that recognizes and binds to CXCR1 or CXCR2. In another illustrative embodiment, the targeting moiety is CXCL8, which is a chemokine that recognizes and binds to CXCR1 or CXCR2. In another illustrative embodiment, the targeting moiety is CXCL9, which is a chemokine that recognizes and binds to CXCR3. In another illustrative embodiment, the targeting moiety is CXCL10, which is a chemokine that recognizes and binds to CXCR3. In another illustrative embodiment, the targeting moiety is CXCL11, which is a chemokine that recognizes and binds to CXCR3 or CXCR7. In another illustrative embodiment, the targeting moiety is CXCL12, which is a chemokine that recognizes and binds to CXCR4 or CXCR7. In another illustrative embodiment, the targeting moiety is CXCL13, which is a chemokine that recognizes and binds to CXCR5. In another illustrative embodiment, the targeting moiety is CXCL16, which is a chemokine that recognizes and binds to CXCR6. In another illustrative embodiment, the targeting moiety is LDGF-PBP, which is a chemokine that recognizes and binds to CXCR2. In another illustrative embodiment, the targeting moiety is XCL2, which is a chemokine that recognizes and binds to XCR1. In another illustrative embodiment, the targeting moiety is CX3CL1, which is a chemokine that recognizes and binds to CX3CR1.

In various embodiments, the present chimeric protein comprises targeting moieties in various combinations. In an illustrative embodiment, the present chimeric protein may comprise two targeting moieties, wherein both targeting moieties are antibodies or derivatives thereof. In another illustrative embodiment, the present chimeric protein may comprise two targeting moieties, wherein both targeting moieties are natural ligands for cell receptors. In a further illustrative embodiment, the present chimeric protein may comprise two targeting moieties, wherein one of the targeting moieties is an antibody or derivative thereof, and the other targeting moiety is a natural ligand for a cell receptor.

In various embodiments, the recognition domain of the present chimeric protein functionally modulates (by way of non-limitation, partially or completely neutralizes) the target (e.g., antigen, receptor) of interest, e.g., substantially inhibiting, reducing, or neutralizing a biological effect that the antigen has. For example, various recognition domains may be directed against one or more tumor antigens that are actively suppressing, or have the capacity to suppress, the immune system of, for example, a patient bearing a tumor. For example, in some embodiments, the present chimeric protein functionally modulates immune inhibitory signals (e.g., checkpoint inhibitors), for example, one or more of TIM-3, BTLA, PD-1, CTLA-4, B7-H4, GITR, galectin-9, HVEM, PD-L1, PD-L2, B7-H3, CD244, CD160, TIGIT, SIRPα, ICOS, CD172a, and TMIGD2. For example, in some embodiments, the present chimeric protein is engineered to disrupt, block, reduce, and/or inhibit the transmission of an immune inhibitory signal, by way of non-limiting example, the binding of PD-1 with PD-L1 or PD-L2 and/or the binding of CTLA-4 with one or more of AP2M1, CD80, CD86, SHP-2, and PPP2R5A.

In various embodiments, the recognition domain of the present chimeric protein binds but does not functionally modulate the target (e.g., antigen, receptor) of interest, e.g., the recognition domain is, or is akin to, a binding antibody. For instance, in various embodiments, the recognition domain simply targets the antigen or receptor but does not substantially inhibit, reduce or functionally modulate a biological effect that the antigen or receptor has. For example, some of the smaller antibody formats described above (e.g., as compared to, for example, full antibodies) have the ability to target hard to access epitopes and provide a larger spectrum of specific binding locales. In various embodiments, the recognition domain binds an epitope that is physically separate from an antigen or receptor site that is important for its biological activity (e.g., the antigen's active site).

Such non-neutralizing binding finds use in various embodiments of the present invention, including methods in which the present chimeric protein is used to directly or indirectly recruit active immune cells to a site of need via an effector antigen, such as any of those described herein. For example, in various embodiments, the present chimeric protein may be used to directly or indirectly recruit cytotoxic T cells via CD8 to a tumor cell in a method of reducing or eliminating a tumor (e.g., the chimeric protein may comprise an anti-CD8 recognition domain and a recognition domain directed against a tumor antigen). In such embodiments, it is desirable to directly or indirectly recruit CD8-expressing cytotoxic T cells but not to functionally modulate the CD8 activity. On the contrary, in these embodiments, CD8 signaling is an important piece of the tumor reducing or eliminating effect. By way of further example, in various methods of reducing or eliminating tumors, the present chimeric protein is used to directly or indirectly recruit dendritic cells (DCs) via CLEC9A (e.g., the chimeric protein may comprise an anti-CLEC9A recognition domain and a recognition domain directed against a tumor antigen). In such embodiments, it is desirable to directly or indirectly recruit CLEC9A-expressing DCs but not to functionally modulate the CLEC9A activity. On the contrary, in these embodiments, CLEC9A signaling is an important piece of the tumor reducing or eliminating effect.

In various embodiments, the recognition domain of the present chimeric protein binds to XCR1 e.g., on dendritic cells. For instance, the recognition domain, in some embodiments comprises all or part of XCL1 or a non-neutralizing anti-XCR1 agent.

In various embodiments, the recognition domain of the present chimeric protein binds to an immune modulatory antigen (e.g., immune stimulatory or immune inhibitory). In various embodiments, the immune modulatory antigen is one or more of 4-1BB, OX-40, HVEM, GITR, CD27, CD28, CD30, CD40, ICOS ligand; OX-40 ligand, LIGHT (CD258), GITR ligand, CD70, B7-1, B7-2, CD30 ligand, CD40 ligand, ICOS, ICOS ligand, CD137 ligand and TL1A. In various embodiments, such immune stimulatory antigens are expressed on a tumor cell. In various embodiments, the recognition domain of the present chimeric protein binds but does not functionally modulate such immune stimulatory antigens and therefore allows recruitment of cells expressing these antigens without the reduction or loss of their potential tumor reducing or eliminating capacity.

In various embodiments, the recognition domain of the present chimeric protein may be in the context of chimeric protein that comprises two recognition domains that have neutralizing activity, or comprises two recognition domains that have non-neutralizing (e.g., binding) activity, or comprises one recognition domain that has neutralizing activity and one recognition domain that has non-neutralizing (e.g., binding) activity.

Additional Signaling Agents

In one aspect, the present invention provides a chimeric protein comprising one or more signaling agents (for instance, an immune-modulating agent) in addition to the modified IFN-γ described herein. In exemplary embodiments, the chimeric protein may comprise two, three, four, five, six, seven, eight, nine, ten or more signaling agents in addition to the modified IFN-γ described herein. In various embodiments, the additional signaling agent is modified to have reduced affinity and/or biological activity for one or more of its receptors, which allows for attenuation of activity (inclusive of agonism or antagonism) and/or prevents non-specific signaling or undesirable sequestration of the chimeric protein.

In various embodiments, the additional signaling agent is antagonistic in its wild type form and bears one or more mutations that attenuate its antagonistic activity. In various embodiments, the additional signaling agent is antagonistic due to one or more mutations, e.g., an agonistic signaling agent is converted to an antagonistic signaling agent and, such a converted signaling agent, optionally, also bears one or more mutations that attenuate its antagonistic activity (e.g., as described in WO 2015/007520, the entire contents of which are hereby incorporated by reference).

In various embodiments, the additional signaling agent is selected from modified versions of cytokines, growth factors, and hormones. Illustrative examples of such cytokines, growth factors, and hormones include, but are not limited to, lymphokines, monokines, traditional polypeptide hormones, such as human growth hormone, N-methionyl human growth hormone, and bovine growth hormone; parathyroid hormone; thyroxine; insulin; proinsulin; relaxin; prorelaxin; glycoprotein hormones such as follicle stimulating hormone (FSH), thyroid stimulating hormone (TSH), and luteinizing hormone (LH); hepatic growth factor; fibroblast growth factor; prolactin; placental lactogen; tumor necrosis factor-α and tumor necrosis factor-β; mullerian-inhibiting substance; mouse gonadotropin-associated peptide; inhibin; activin; vascular endothelial growth factor; integrin; thrombopoietin (TPO); nerve growth factors such as NGF-α; platelet-growth factor; transforming growth factors (TGFs) such as TGF-α and TGF-β; insulin-like growth factor-I and -II; osteo inductive factors; interferons such as, for example, interferon-α, interferon-β and interferon-γ (and interferon type I, II, and III), colony stimulating factors (CSFs) such as macrophage-CSF (M-CSF); granulocyte-macrophage-CSF (GM-CSF); and granulocyte-CSF (G-CSF); interleukins (ILs) such as, for example, IL-1, IL-1α, IL-2, IL-3, IL-4, IL-5, IL-6, IL-7, IL-8, IL-9, IL-10, IL-11, IL-12, IL-13, and IL-18; a tumor necrosis factor such as, for example, TNF-α or TNF-β; and other polypeptide factors including, for example, LIF and kit ligand (KL). As used herein, cytokines, growth factors, and hormones include proteins obtained from natural sources or produced from recombinant bacterial, eukaryotic or mammalian cell culture systems and biologically active equivalents of the native sequence cytokines.

In some embodiments, the additional signaling agent is a modified version of a growth factor selected from, but not limited to, transforming growth factors (TGFs) such as TGF-α and TGF-β, epidermal growth factor (EGF), insulin-like growth factor such as insulin-like growth factor-I and -II, fibroblast growth factor (FGF), heregulin, platelet-derived growth factor (PDGF), vascular endothelial growth factor (VEGF).

In an embodiment, the growth factor is a modified version of a fibroblast growth factor (FGF). Illustrative FGFs include, but are not limited to, FGF1, FGF2, FGF3, FGF4, FGF5, FGF6, FGF7, FGF8, FGF9, FGF10, FGF11, FGF12, FGF13, FGF14, murine FGF15, FGF16, FGF17, FGF18, FGF19, FGF20, FGF21, FGF22, and FGF23.

In an embodiment, the growth factor is a modified version of a vascular endothelial growth factor (VEGF). Illustrative VEGFs include, but are not limited to, VEGF-A, VEGF-B, VEGF-C, VEGF-D, and PGF and isoforms thereof including the various isoforms of VEGF-A such as $VEGF_{121}$, $VEGF_{121}$b, $VEGF_{145}$, $VEGF_{165}$, $VEGF_{165}$b, $VEGF_{189}$, and $VEGF_{206}$.

In an embodiment, the growth factor is a modified version of a transforming growth factor (TGF). Illustrative TGFs include, but are not limited to, TGF-α and TGF-β and subtypes thereof including the various subtypes of TGF-β including TGFβ1, TGFβ2, and TGFβ3.

In some embodiments, the additional signaling agent is a modified version of a hormone selected from, but not limited to, human chorionic gonadotropin, gonadotropin releasing hormone, an androgen, an estrogen, thyroid-stimulating hormone, follicle-stimulating hormone, luteinizing hormone, prolactin, growth hormone, adrenocorticotropic hormone, antidiuretic hormone, oxytocin, thyrotropin-releasing hormone, growth hormone releasing hormone, corticotropin-releasing hormone, somatostatin, dopamine, melatonin, thyroxine, calcitonin, parathyroid hormone, glucocorticoids, mineralocorticoids, adrenaline, noradrenaline, progesterone, insulin, glucagon, amylin, calcitriol, calciferol, atrial-natriuretic peptide, gastrin, secretin, cholecystokinin, neuropeptide Y, ghrelin, PYY3-36, insulin-like growth factor (IGF), leptin, thrombopoietin, erythropoietin (EPO), and angiotensinogen.

In some embodiments, the additional signaling agent is an immune-modulating agent, e.g., one or more of an interleukin, interferon, and tumor necrosis factor.

In some embodiments, the additional signaling agent is an interleukin, including for example IL-1; IL-2; IL-3; IL-4; IL-5; IL-6; IL-7; IL-8; IL-9; IL-10; IL-11; IL-12; IL-13; IL-14; IL-15; IL-16; IL-17; IL-18; IL-19; IL-20; IL-21; IL-22; IL-23; IL-24; IL-25; IL-26; IL-27; IL-28; IL-29; IL-30; IL-31; IL-32; IL-33; IL-35; IL-36 or a fragment, variant, analogue, or family-member thereof. Interleukins are a group of multi-functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Orencole & Dinarello (1989) Cytokine 1, 14-20.

In some embodiments, the additional signaling agent is a modified version of an interferon such as interferon types I, II, and III. Illustrative interferons, include, for example, interferon-α, interferon-β, another interferon-γ, interferon κ, interferon ε, interferon τ, and interferon ω̃.

In some embodiments, the additional signaling agent is a modified version of a tumor necrosis factor (TNF) or a protein in the TNF family, including but not limited to, TNF-α, TNF-β, LT-β, CD40L, CD27L, CD30L, FASL, 4-1BBL, OX40L, and TRAIL.

In various embodiments, the additional signaling agent is a modified (e.g., mutant) form of the signaling agent having one or more mutations. In various embodiments, the mutations allow for the modified signaling agent to have one or more of attenuated activity such as one or more of reduced binding affinity, reduced endogenous activity, and reduced specific bioactivity relative to unmodified or unmutated, i.e., the wild type form of the signaling agent (e.g., comparing the same signaling agent in a wild type form versus a modified (e.g., mutant) form). In some embodiments, the mutations which attenuate or reduce binding or affinity include those mutations which substantially reduce or ablate binding or activity. In some embodiments, the mutations which attenuate or reduce binding or affinity are different than those mutations which substantially reduce or ablate binding or activity. Consequentially, in various embodiments, the mutations allow for the signaling agent to be more safe, e.g., have reduced systemic toxicity, reduced side effects, and reduced off-target effects relative to unmutated, i.e., wild type, signaling agent (e.g., comparing the same signaling agent in a wild type form versus a modified (e.g., mutant) form).

In various embodiments, the additional signaling agent is modified to have one or more mutations that reduce its binding affinity or activity for one or more of its receptors. In some embodiments, the signaling agent is modified to have one or more mutations that substantially reduce or ablate binding affinity or activity for the receptors. In some embodiments, the activity provided by the wild type signaling agent is agonism at the receptor (e.g., activation of a cellular effect at a site of therapy). For example, the wild type signaling agent may activate its receptor. In such embodiments, the mutations result in the modified signaling agent to have reduced or ablated activating activity at the receptor. For example, the mutations may result in the modified signaling agent to deliver a reduced activating signal to a target cell or the activating signal could be ablated. In some embodiments, the activity provided by the wild type signaling agent is antagonism at the receptor (e.g., blocking or dampening of a cellular effect at a site of therapy). For example, the wild type signaling agent may antagonize or inhibit the receptor. In these embodiments, the mutations result in the modified signaling agent to have a reduced or ablated antagonizing activity at the receptor. For example, the mutations may result in the modified signaling agent to deliver a reduced inhibitory signal to a target cell or the inhibitory signal could be ablated. In various embodiments, the signaling agent is antagonistic due to one or more mutations, e.g., an agonistic signaling agent is converted to an antagonistic signaling agent (e.g., as described in WO 2015/007520, the entire contents of which are hereby incorporated by reference) and, such a converted signaling agent, optionally, also bears one or more mutations that reduce its binding affinity or activity for one or more of its receptors or that substantially reduce or ablate binding affinity or activity for one or more of its receptors.

In some embodiments, the reduced affinity and/or biological activity at the receptor is restorable by attachment with one or more of the targeting moieties. In other embodiments, the reduced affinity and/or biological activity at the receptor is not substantially restorable by the activity of one or more of the targeting moieties.

In various embodiments, the additional signaling agent is active on target cells because the targeting moiety(ies) compensates for the missing/insufficient binding (e.g., without limitation and/or avidity) required for substantial activation. In various embodiments, the modified signaling agent is substantially inactive en route to the site of therapeutic activity and has its effect substantially on specifically targeted cell types which greatly reduces undesired side effects.

In some embodiments, the additional signaling agent may include one or more mutations that attenuate or reduce binding or affinity for one receptor (i.e., a therapeutic receptor) and one or more mutations that substantially reduce or ablate binding or activity at a second receptor. In such embodiments, these mutations may be at the same or at different positions (i.e., the same mutation or multiple mutations). In some embodiments, the mutation(s) that reduce binding and/or activity at one receptor is different than the mutation(s) that substantially reduce or ablate at another receptor. In some embodiments, the mutation(s) that reduce binding and/or activity at one receptor is the same as the mutation(s) that substantially reduce or ablate at another receptor. In some embodiments, the present chimeric proteins have a modified signaling agent that has both mutations that attenuate binding and/or activity at a therapeutic receptor and therefore allow for a more controlled, on-target therapeutic effect (e.g., relative wild type signaling agent) and mutations that substantially reduce or ablate binding and/or activity at another receptor and therefore reduce side effects (e.g., relative to wild type signaling agent).

In some embodiments, the substantial reduction or ablation of binding or activity is not substantially restorable with a targeting moiety. In some embodiments, the substantial reduction or ablation of binding or activity is restorable with a targeting moiety. In various embodiments, substantially reducing or ablating binding or activity at a second receptor also may prevent deleterious effects that are mediated by the other receptor. Alternatively, or in addition, substantially reducing or ablating binding or activity at the other receptor causes the therapeutic effect to improve as there is a reduced or eliminated sequestration of the therapeutic chimeric proteins away from the site of therapeutic action. For instance, in some embodiments, this obviates the need of high doses of the present chimeric proteins that compensate for loss at the other receptor. Such ability to reduce dose further provides a lower likelihood of side effects.

In various embodiments, the additional modified signaling agent comprises one or more mutations that cause the signaling agent to have reduced, substantially reduced, or ablated affinity, e.g., binding (e.g., $K_D$) and/or activation (for instance, when the modified signaling agent is an agonist of its receptor, measurable as, for example, $K_A$ and/or $EC_{50}$) and/or inhibition (for instance, when the modified signaling agent is an antagonist of its receptor, measurable as, for example, $K_I$ and/or $IC_{50}$), for one or more of its receptors. In various embodiments, the reduced affinity at the signaling agent's receptor allows for attenuation of activity (inclusive of agonism or antagonism). In such embodiments, the modified signaling agent has about 1%, or about 3%, about 5%, about 10%, about 15%, about 20%, about 25%, about 30%, about 35%, about 40%, about 45%, about 50%, about 60%, about 65%, about 70%, about 75%, about 80%, about 85%, about 90%, about 95%, or about 10%-20%, about 20%-40%, about 50%, about 40%-60%, about 60%-80%, about 80%-100% of the affinity for the receptor relative to the wild type signaling agent. In some embodiments, the binding affinity is at least about 2-fold lower, about 3-fold lower, about 4-fold lower, about 5-fold lower, about 6-fold lower, about 7-fold lower, about 8-fold lower, about 9-fold lower, at least about 10-fold lower, at least about 15-fold lower, at least about 20-fold lower, at least about 25-fold lower, at least about 30-fold lower, at least about 35-fold lower, at least about 40-fold lower, at least about 45-fold lower, at least about 50-fold lower, at least about 100-fold lower, at least about 150-fold lower, or about 10-50-fold lower, about 50-100-fold lower, about 100-150-fold lower, about 150-200-fold lower, or more than 200-fold lower relative to the wild type signaling agent.

In embodiments wherein the chimeric protein has mutations that reduce binding at one receptor and substantially reduce or ablate binding at a second receptor, the attenuation or reduction in binding affinity of a modified signaling agent for one receptor is less than the substantial reduction or ablation in affinity for the other receptor. In some embodiments, the attenuation or reduction in binding affinity of a modified signaling agent for one receptor is less than the substantial reduction or ablation in affinity for the other receptor by about 1%, or about 3%, about 5%, about 10%, about 15%, about 20%, about 25%, about 30%, about 35%, about 40%, about 45%, about 50%, about 60%, about 65%, about 70%, about 75%, about 80%, about 85%, about 90%, or about 95%. In various embodiments, substantial reduction or ablation refers to a greater reduction in binding affinity and/or biological activity than attenuation or reduction.

In various embodiments, the additional modified signaling agent comprises one or more mutations that reduce the endogenous activity of the signaling agent to about 75%, or about 70%, or about 60%, or about 50%, or about 40%, or about 30%, or about 25%, or about 20%, or about 10%, or about 5%, or about 3%, or about 1%, e.g., relative to the wild type signaling agent In various embodiments, the additional modified signaling agent comprises one or more mutations that cause the signaling agent to have reduced affinity and/or biological activity for a receptor of any one of the cytokines, growth factors, and hormones as described herein.

In some embodiments, the additional modified signaling agent comprises one or more mutations that cause the signaling agent to have reduced affinity for its receptor that is lower than the binding affinity of the targeting moiety(ies) for its(their) receptor(s). In some embodiments, this binding affinity differential is between signaling agent/receptor and targeting moiety/receptor on the same cell. In some embodiments, this binding affinity differential allows for the signaling agent, e.g., mutated signaling agent, to have localized, on-target effects and to minimize off-target effects that underlie side effects that are observed with wild type signaling agent. In some embodiments, this binding affinity is at least about 2-fold, or at least about 5-fold, or at least about 10-fold, or at least about 15-fold lower, or at least about 25-fold, or at least about 50-fold lower, or at least about 100-fold, or at least about 150-fold.

Receptor binding activity may be measured using methods known in the art. For example, affinity and/or binding activity may be assessed by Scatchard plot analysis and computer-fitting of binding data (e.g., Scatchard, 1949) or by reflectometric interference spectroscopy under flow through conditions, as described by Brecht et al. (1993), the entire contents of all of which are hereby incorporated by reference.

The amino acid sequences of the wild type signaling agents described herein are well known in the art. Accordingly, in various embodiments the additional modified signaling agent comprises an amino acid sequence that has at least about 60%, or at least about 61%, or at least about 62%, or at least about 63%, or at least about 64%, or at least about 65%, or at least about 66%, or at least about 67%, or at least about 68%, or at least about 69%, or at least about 70%, or at least about 71%, or at least about 72%, or at least about 73%, or at least about 74%, or at least about 75%, or at least about 76%, or at least about 77%, or at least about 78%, or at least about 79%, or at least about 80%, or at least about 81%, or at least about 82%, or at least about 83%, or at least about 84%, or at least about 85%, or at least about 86%, or at least about 87%, or at least about 88%, or at least about 89%, or at least about 90%, or at least about 91%, or at least about 92%, or at least about 93%, or at least about 94%, or at least about 95%, or at least about 96%, or at least about 97%, or at least about 98%, or at least about 99% sequence identity with the known wild type amino acid sequences of the signaling agents described herein (e.g., about 60%, or about 61%, or about 62%, or about 63%, or about 64%, or about 65%, or about 66%, or about 67%, or about 68%, or about 69%, or about 70%, or about 71%, or about 72%, or about 73%, or about 74%, or about 75%, or about 76%, or about 77%, or about 78%, or about 79%, or about 80%, or about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, or about 99% sequence identity).

In various embodiments the additional modified signaling agent comprises an amino acid sequence that has at least about 60%, or at least about 61%, or at least about 62%, or at least about 63%, or at least about 64%, or at least about 65%, or at least about 66%, or at least about 67%, or at least about 68%, or at least about 69%, or at least about 70%, or at least about 71%, or at least about 72%, or at least about 73%, or at least about 74%, or at least about 75%, or at least about 76%, or at least about 77%, or at least about 78%, or at least about 79%, or at least about 80%, or at least about 81%, or at least about 82%, or at least about 83%, or at least about 84%, or at least about 85%, or at least about 86%, or at least about 87%, or at least about 88%, or at least about 89%, or at least about 90%, or at least about 91%, or at least about 92%, or at least about 93%, or at least about 94%, or at least about 95%, or at least about 96%, or at least about 97%, or at least about 98%, or at least about 99% sequence identity with any of the sequences disclosed herein (e.g., about 60%, or about 61%, or about 62%, or about 63%, or about 64%, or about 65%, or about 66%, or about 67%, or about 68%, or about 69%, or about 70%, or about 71%, or about 72%, or about 73%, or about 74%, or about 75%, or about 76%, or about 77%, or about 78%, or about 79%, or about 80%, or about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, or about 99% sequence identity).

In various embodiments, the additional modified signaling agent comprises an amino acid sequence having one or more amino acid mutations. In some embodiments, the one or more amino acid mutations may be independently selected from substitutions, insertions, deletions, and truncations.

In some embodiments, the amino acid mutations are amino acid substitutions, and may include conservative and/or non-conservative substitutions as described herein.

As described herein, the additional modified signaling agents bear mutations that affect affinity and/or activity at one or more receptors. In various embodiments, there is reduced affinity and/or activity at a therapeutic receptor, e.g., a receptor through which a desired therapeutic effect is mediated (e.g., agonism or antagonism). In various embodiments, the modified signaling agents bear mutations that substantially reduce or ablate affinity and/or activity at a receptor, e.g., a receptor through which a desired therapeutic effect is not mediated (e.g., as the result of promiscuity of binding). The receptors of any modified signaling agents, e.g., one of the cytokines, growth factors, and hormones as described herein, are known in the art.

Illustrative mutations which provide reduced affinity and/or activity (e.g., agonistic) at a receptor are found in WO 2013/107791 (e.g., with regard to interferons), WO 2015/007542 (e.g., with regard to interleukins), and WO 2015/007903 (e.g., with regard to TNF), the entire contents of each of which are hereby incorporated by reference. Illustrative mutations which provide reduced affinity and/or activity (e.g., antagonistic) at a therapeutic receptor are found in WO 2015/007520, the entire contents of which are hereby incorporated by reference.

In some embodiments, the additional modified signaling agent comprises one or more mutations that cause the signaling agent to have reduced affinity and/or activity for a type I cytokine receptor, a type II cytokine receptor, a chemokine receptor, a receptor in the Tumor Necrosis Factor Receptor (TNFR) superfamily, TGF-beta Receptors, a receptor in the immunoglobulin (Ig) superfamily, and/or a receptor in the tyrosine kinase superfamily.

In various embodiments, the receptor for the additional signaling agent is a Type I cytokine receptor. Type I cytokine receptors are known in the art and include, but are not limited to receptors for IL2 (beta-subunit), IL3, IL4, IL5, IL6, IL7, IL9, IL11, IL12, GM-CSF, G-CSF, LIF, CNTF, and also the receptors for Thrombopoietin (TPO), Prolactin, and Growth hormone. Illustrative type I cytokine receptors include, but are not limited to, GM-CSF receptor, G-CSF receptor, LIF receptor, CNTF receptor, TPO receptor, and type I IL receptors.

In various embodiments, the receptor for the additional signaling agent is a Type II cytokine receptor. Type II cytokine receptors are multimeric receptors composed of heterologous subunits, and are receptors mainly for interferons. This family of receptors includes, but is not limited to, receptors for interferon-α, interferon-β and interferon-γ, IL10, IL22, and tissue factor. Illustrative type II cytokine receptors include, but are not limited to, IFN-α receptor (e.g., IFNAR1 and IFNAR2), IFN-β receptor, IFN-γ receptor (e.g., IFNGR1 and IFNGR2), and type II IL receptors.

In various embodiments, the receptor for the additional signaling agent is a G protein-coupled receptor. Chemokine receptors are G protein-coupled receptors with seven transmembrane structure and coupled to G-protein for signal transduction. Chemokine receptors include, but are not limited to, CC chemokine receptors, CXC chemokine receptors, CX3C chemokine receptors, and XC chemokine receptor (XCR1). Exemplary chemokine receptors include, but are not limited to, CCR1, CCR2, CCR3, CCR4, CCR5, CCR6, CCR7, CCR8, CCR9, CCR10, CXCR1, CXCR2, CXCR3, CXCR3B, CXCR4, CXCR5, CSCR6, CXCR7, XCR1, and CX3CR1.

In various embodiments, the receptor for the additional signaling agent is a TNFR family member. Tumor necrosis factor receptor (TNFR) family members share a cysteine-rich domain (CRD) formed of three disulfide bonds surrounding a core motif of CXXCXXC creating an elongated molecule. Exemplary tumor necrosis factor receptor family members include: CDI 20a (TNFRSFIA), CD 120b (TNFRSF1B), Lymphotoxin beta receptor (LTBR, TNFRSF3), CD 134 (TNFRSF4), CD40 (CD40, TNFRSF5), FAS (FAS, TNFRSF6), TNFRSF6B (TNFRSF6B), CD27 (CD27, TNFRSF7), CD30 (TNFRSF8), CD137 (TNFRSF9), TNFRSF10A (TNFRSF10A), TNFRSF10B, (TNFRSF10B), TNFRSF10C (TNFRSF10C), TNFRSF10D (TNFRSF10D), RANK (TNFRSFI IA), Osteoprotegerin (TNFRSFI IB), TNFRSF12A (TNFRSF12A), TNFRSF13B (TNFRSF13B), TNFRSF13C (TNFRSF13C), TNFRSF14 (TNFRSF14), Nerve growth factor receptor (NGFR, TNFRSF16), TNFRSF17 (TNFRSF17), TNFRSF18 (TNFRSF18), TNFRSF19 (TNFRSF19), TNFRSF21 (TNFRSF21), and TNFRSF25 (TNFRSF25).

In various embodiments, the receptor for the additional signaling agent is a TGF-beta receptor. TGF-beta receptors are single pass serine/threonine kinase receptors. TGF-beta receptors include, but are not limited to, TGFBR1, TGFBR2, and TGFBR3.

In various embodiments, the receptor for the additional signaling agent is an Ig superfamily receptor. Receptors in the immunoglobulin (Ig) superfamily share structural homology with immunoglobulins. Receptors in the Ig superfamily include, but are not limited to, interleukin-1 receptors, CSF-1R, PDGFR (e.g., PDGFRA and PDGFRB), and SCFR.

In various embodiments, the receptor for the additional signaling agent is a tyrosine kinase superfamily receptor. Receptors in the tyrosine kinase superfamily are well known in the art. There are about 58 known receptor tyrosine kinases (RTKs), grouped into 20 subfamilies. Receptors in the tyrosine kinase superfamily include, but are not limited to, FGF receptors and their various isoforms such as FGFR1, FGFR2, FGFR3, FGFR4, and FGFR5.

In an embodiment, the additional modified signaling agent is interferon β. In such embodiments, the modified interferon β agent has reduced affinity and/or activity for the IFN-α/β receptor (IFNAR), i.e., IFNAR1 and/or IFNAR2 chains. In some embodiments, the modified interferon β agent has substantially reduced or ablated affinity and/or activity for the IFN-α/β receptor (IFNAR), i.e., IFNAR1 and/or IFNAR2 chains.

In an embodiment, the additional modified signaling agent is another interferon γ. In such embodiments, the modified interferon γ agent also has reduced affinity and/or activity for the interferon-γ receptor (IFNGR), i.e., the interferon-γ receptor 1 and/or interferon-γ receptor 2 subunits. In some embodiments, the modified interferon γ agent has substantially reduced or ablated affinity and/or activity for the interferon-γ receptor, i.e., the interferon-γ receptor 1 and/or interferon-γ receptor 2 subunits.

In some embodiments, the additional modified signaling agent is vascular endothelial growth factor (VEGF). VEGF is a potent growth factor that plays major roles in physiological but also pathological angiogenesis, regulates vascular permeability and can act as a growth factor on cells expressing VEGF receptors. Additional functions include, among others, stimulation of cell migration in macrophage lineage and endothelial cells. Several members of the VEGF family of growth factors exist, as well as at least three receptors (VEGFR-1, VEGFR-2, and VEGFR-3). Members of the VEGF family can bind and activate more than one VEGFR type. For example, VEGF-A binds VEGFR-1 and -2, while VEGF-C can bind VEGFR-2 and -3. VEGFR-1 and -2 activation regulates angiogenesis while VEGFR-3 activation is associated with lymphangiogenesis. The major pro-angiogenic signal is generated from activation of VEGFR-2. VEGFR-1 activation has been reported to be possibly associated with negative role in angiogenesis. It has also been reported that VEGFR-1 signaling is important for progression of tumors in vivo via bone marrow-derived VEGFR-1 positive cells (contributing to formation of premetastatic niche in the bone). Several therapies based on VEGF-A directed/neutralizing therapeutic antibodies have been developed, primarily for use in treatment of various human tumors relying on angiogenesis. These are not without side effects though. This may not be surprising considering that these operate as general, non-cell/tissue specific VEGF/VEGFR interaction inhibitors. Hence, it would be desirable to restrict VEGF (e.g., VEGF-A)/VEGFR-2 inhibition to specific target cells (e.g., tumor vasculature endothelial cells).

In some embodiments, the VEGF is VEGF-A, VEGF-B, VEFG-C, VEGF-D, or VEGF-E and isoforms thereof including the various isoforms of VEGF-A such as $VEGF_{121}$, $VEGF_{121}b$, $VEGF_{145}$, $VEGF_{165}$, $VEGF_{165}b$, $VEGF_{189}$, and $VEGF_{206}$.

In some embodiments, the modified signaling agent has reduced affinity and/or activity for VEGFR-1 (Flt-1) and/or VEGFR-2 (KDR/Flk-1). In some embodiments, the modified signaling agent has substantially reduced or ablated affinity and/or activity for VEGFR-1 (Flt-1) and/or VEGFR-2 (KDR/Flk-1). In an embodiment, the modified signaling agent has reduced affinity and/or activity for VEGFR-2 (KDR/Flk-1) and/or substantially reduced or ablated affinity and/or activity for VEGFR-1 (Flt-1). Such an embodiment finds use, for example, in wound healing methods or treatment of ischemia-related diseases (without wishing to be bound by theory, mediated by VEGFR-2's effects on endothelial cell function and angiogenesis). In various embodiments, binding to VEGFR-1 (Flt-1), which is linked to cancers and pro-inflammatory activities, is avoided. In various embodiments, VEGFR-1 (Flt-1) acts a decoy receptor and therefore substantially reduces or ablates affinity and/or activity at this receptor avoids sequestration of the therapeutic agent. In an embodiment, the modified signaling agent has substantially reduced or ablated affinity and/or activity for VEGFR-1 (Flt-1) and/or substantially reduced or ablated affinity and/or activity for VEGFR-2 (KDR/Flk-1). In some embodiments, the VEGF is VEGF-C or VEGF-D. In such embodiments, the modified signaling agent has reduced affinity and/or activity for VEGFR-3. Alternatively, the modified signaling agent has substantially reduced or ablated affinity and/or activity for VEGFR-3.

Proangiogenic therapies are also important in various diseases (e.g., ischemic heart disease, bleeding etc.), and include VEGF-based therapeutics. Activation of VEGFR-2 is proangiogenic (acting on endothelial cells). Activation of VEFGR-1 can cause stimulation of migration of inflammatory cells (including, for example, macrophages) and lead to inflammation associated hypervascular permeability. Activation of VEFGR-1 can also promote bone marrow associated tumor niche formation. Thus, VEGF based therapeutic selective for VEGFR-2 activation would be desirable in this case. In addition, cell specific targeting, e.g., to endothelial cells, would be desirable.

In some embodiments, the additional modified signaling agent has reduced affinity and/or activity (e.g., antagonistic) for VEGFR-2 and/or has substantially reduced or ablated affinity and/or activity for VEGFR-1. When targeted to tumor vasculature endothelial cells via a targeting moiety that binds to a tumor endothelial cell marker (e.g., PSMA and others), such construct inhibits VEGFR-2 activation specifically on such marker-positive cells, while not activating VEGFR-1 en route and on target cells (if activity ablated), thus eliminating induction of inflammatory responses, for example. This would provide a more selective and safe anti-angiogenic therapy for many tumor types as compared to VEGF-A neutralizing therapies.

In some embodiments, the additional modified signaling agent has reduced affinity and/or activity (e.g., agonistic) for VEGFR-2 and/or has substantially reduced or ablated affinity and/or activity for VEGFR-1. Through targeting to vascular endothelial cells, such construct, in some embodiments, promotes angiogenesis without causing VEGFR-1 associated induction of inflammatory responses. Hence, such a construct would have targeted proangiogenic effects with substantially reduced risk of side effects caused by systemic activation of VEGFR-2 as well as VEFGR-1.

In an illustrative embodiment, the modified signaling agent is $VEGF_{165}$, which has the amino acid sequence of SEQ ID NO: 237.

In another illustrative embodiment, the additional modified signaling agent is $VEGF_{165}b$, which has the amino acid sequence of SEQ ID NO: 288.

In these embodiments, the modified signaling agent has a mutation at amino acid I83 (e.g., a substitution mutation at I83, e.g., I83K, I83R, or I83H). Without wishing to be bound by theory, it is believed that such mutations may result in reduced receptor binding affinity. See, for example, U.S. Pat. No. 9,078,860, the entire contents of which are hereby incorporated by reference.

In an embodiment, the additional modified signaling agent is TNF-α. TNF is a pleiotropic cytokine with many diverse functions, including regulation of cell growth, differentiation, apoptosis, tumorigenesis, viral replication, autoimmunity, immune cell functions and trafficking, inflammation, and septic shock. It binds to two distinct membrane receptors on target cells: TNFR1 (p55) and TNFR2 (p75). TNFR1 exhibits a very broad expression pattern whereas TNFR2 is expressed preferentially on certain populations of lymphocytes, Tregs, endothelial cells, certain neurons, microglia, cardiac myocytes and mesenchymal stem cells. Very distinct biological pathways are activated in response to receptor activation, although there is also some overlap. As a general rule, without wishing to be bound by theory, TNFR1 signaling is associated with induction of apoptosis (cell death) and TNFR2 signaling is associated with activation of cell survival signals (e.g., activation of NFkB pathway). Administration of TNF is systemically toxic, and this is largely due to TNFR1 engagement. However, it should be noted that activation of TNFR2 is also associated with a broad range of activities and, as with TNFR1, in the context of developing TNF based therapeutics, control over TNF targeting and activity is important.

In some embodiments, the additional modified signaling agent has reduced affinity and/or activity for TNFR1 and/or TNFR2. In some embodiments, the modified signaling agent has substantially reduced or ablated affinity and/or activity for TNFR1 and/or TNFR2. TNFR1 is expressed in most tissues, and is involved in cell death signaling while, by contrast, TNFR2 is involved in cell survival signaling. Accordingly, in embodiments directed to methods of treating cancer, the modified signaling agent has reduced affinity and/or activity for TNFR1 and/or substantially reduced or ablated affinity and/or activity for TNFR2. In these embodiments, the chimeric proteins may be targeted to a cell for which apoptosis is desired, e.g., a tumor cell or a tumor vasculature endothelial cell. In embodiments directed to methods of promoting cell survival, for example, in neurogenesis for the treatment of neurodegenerative disorders, the modified signaling agent has reduced affinity and/or activity for TNFR2 and/or substantially reduced or ablated affinity and/or activity for TNFR1. Stated another way, the present chimeric proteins, in some embodiments, comprise modified TNF-α agent that allows of favoring either death or survival signals.

In some embodiments, the chimeric protein has a modified TNF having reduced affinity and/or activity for TNFR1 and/or substantially reduced or ablated affinity and/or activity for TNFR2. Such a chimera, in some embodiments, is a more potent inducer of apoptosis as compared to a wild type TNF and/or a chimera bearing only mutation(s) causing reduced affinity and/or activity for TNFR1. Such a chimera, in some embodiments, finds use in inducing tumor cell death or a tumor vasculature endothelial cell death (e.g., in the treatment of cancers). Also, in some embodiments, these chimeras avoid or reduce activation of $T_{reg}$ cells via TNFR2, for example, thus further supporting TNFR1-mediated anti-tumor activity in vivo.

In some embodiments, the chimeric protein has a modified TNF having reduced affinity and/or activity for TNFR2 and/or substantially reduced or ablated affinity and/or activity for TNFR1. Such a chimera, in some embodiments, is a more potent activator of cell survival in some cell types, which may be a specific therapeutic objective in various disease settings, including without limitation, stimulation of neurogenesis. In addition, such a TNFR2-favoring chimeras also are useful in the treatment of autoimmune diseases (e.g., Crohn's, diabetes, MS, colitis etc. and many others described herein). In some embodiments, the chimera is targeted to auto-reactive T cells. In some embodiments, the chimera promotes $T_{reg}$ cell activation and indirect suppression of cytotoxic T cells.

In some embodiments, the chimera causes the death of auto-reactive T cells, e.g., by activation of TNFR2 and/or avoidance of TNFR1 (e.g., a modified TNF having reduced affinity and/or activity for TNFR2 and/or substantially reduced or ablated affinity and/or activity for TNFR1). Without wishing to be bound by theory these auto-reactive T cells, have their apoptosis/survival signals altered e.g., by NFkB pathway activity/signaling alterations.

In some embodiments, a TNFR2 based chimera has additional therapeutic applications in diseases, including various autoimmune diseases, heart disease, de-myelinating and neurodegenerative disorders, and infectious disease, among others.

In an embodiment, the wild type TNF-α has the amino acid sequence of SEQ ID NO: 239.

In such embodiments, the modified TNF-α agent has mutations at one or more amino acid positions 29, 31, 32, 84, 85, 86, 87, 88, 89, 145, 146 and 147 which produces a modified TNF-α with reduced receptor binding affinity. See, for example, U.S. Pat. No. 7,993,636, the entire contents of which are hereby incorporated by reference.

In some embodiments, the modified human TNF-α moiety has mutations at one or more amino acid positions R32, N34, Q67, H73, L75, T77, S86, Y87, V91, I97, T105, P106, A109, P113, Y115, E127, N137, D143, and A145, as described, for example, in WO/2015/007903, the entire contents of which is hereby incorporated by reference (numbering according to the human TNF sequence, Genbank accession number BAG70306, version BAG70306.1 GI: 197692685). In some embodiments, the modified human TNF-α moiety has substitution mutations selected from R32G, N34G, Q67G, H73G, L75G, L75A, L75S, T77A, S86G, Y87Q, Y87L, Y87A, Y87F, V91G, V91A, I97A, I97Q, I97S, T105G, P106G, A109Y, P113G, Y115G, Y115A, E127G, N137G, D143N, A145G and A145T. In an embodiment, the human TNF-α moiety has a mutation selected from Y87Q, Y87L, Y87A, and Y87F. In another embodiment, the human TNF-α moiety has a mutation selected from I97A, I97Q, and I97S. In a further embodiment, the human TNF-α moiety has a mutation selected from Y115A and Y115G.

In some embodiments, the modified TNF-α agent has one or more mutations selected from N39Y, S147Y, and Y87H, as described in WO2008/124086, the entire contents of which is hereby incorporated by reference.

In an embodiment, the additional modified signaling agent is TNF-β. TNF-β can form a homotrimer or a heterotrimer with LT-β (LT-α1β2). In some embodiments, the modified signaling agent has substantially reduced or ablated affinity and/or activity for TNFR1 and/or TNFR2 and/or herpes virus entry mediator (HEVM) and/or LT-βR.

In an embodiment, the wild type TNF-β has the amino acid sequence of SEQ ID NO: 240.

In such embodiments, the modified TNF-β agent may comprise mutations at one or more amino acids at positions 106-113, which produce a modified TNF-β with reduced receptor binding affinity and/or activity to TNFR2. In an embodiment, the modified signaling agent has one or more substitution mutations at amino acid positions 106-113. In illustrative embodiments, the substitution mutations are selected from Q107E, Q107D, S106E, S106D, Q107R, Q107N, Q107E/S106E, Q107E/S106D, Q107D/S106E, and Q107D/S106D. In another embodiment, the modified signaling agent has an insertion of about 1 to about 3 amino acids at positions 106-113.

In some embodiments, the additional modified agent is a TNF family member (e.g., TNF-alpha, TNF-beta) which can be a single chain trimeric version as described in WO 2015/007903, the entire contents of which are incorporated by reference.

In some embodiments, the modified agent is a TNF family member (e.g., TNF-alpha, TNF-beta) which has reduced affinity and/or activity, i.e., antagonistic activity (e.g., natural antagonistic activity or antagonistic activity that is the result of one or more mutations, see, e.g., WO 2015/007520, the entire contents of which are hereby incorporated by reference) at TNFR1. In these embodiments, the modified agent is a TNF family member (e.g., TNF-alpha, TNF-beta) which also, optionally, has substantially reduced or ablated affinity and/or activity for TNFR2. In some embodiments, the modified agent is a TNF family member (e.g., TNF-alpha, TNF-beta) which has reduced affinity and/or activity, i.e., antagonistic activity (e.g., natural antagonistic activity or antagonistic activity that is the result of one or more mutations, see, e.g., WO 2015/007520, the entire contents of which are hereby incorporated by reference) at TNFR2. In these embodiments, the modified agent is a TNF family member (e.g., TNF-alpha, TNF-beta) which also, optionally, has substantially reduced or ablated affinity and/or activity for TNFR1. The constructs of such embodiments find use in, for example, methods of dampening TNF response in a cell specific manner. In some embodiments, the antagonistic TNF family member (e.g., TNF-alpha, TNF-beta) is a single chain trimeric version as described in WO 2015/007903.

In an embodiment, the additional modified signaling agent is TRAIL. In some embodiments, the modified TRAIL agent has reduced affinity and/or activity for DR4 (TRAIL-RI) and/or DR5 (TRAIL-RII) and/or DcR1 and/or DcR2. In some embodiments, the modified TRAIL agent has substantially reduced or ablated affinity and/or activity for DR4 (TRAIL-RI) and/or DR5 (TRAIL-RII) and/or DcR1 and/or DcR2.

In an embodiment, the wild type TRAIL has the amino acid sequence of SEQ ID NO: 241.

In such embodiments, the modified TRAIL agent may comprise a mutation at amino acid positions T127-R132, E144-R149, E155-H161, Y189-Y209, T214-1220, K224-A226, W231, E236-L239, E249-K251, T261-H264 and H270-E271 (Numbering based on the human sequence, Genbank accession number NP_003801, version 10 NP_003801.1, GI: 4507593; see above).

In an embodiment, the additional modified signaling agent is TGFα. In such embodiments, the modified TGFα agent has reduced affinity and/or activity for the epidermal growth factor receptor (EGFR). In some embodiments, the modified TGFα agent has substantially reduced or ablated affinity and/or activity for the epidermal growth factor receptor (EGFR).

In an embodiment, the additional modified signaling agent is TGFβ. In such embodiments, the modified signaling agent has reduced affinity and/or activity for TGFBR1 and/or TGFBR2. In some embodiments, the modified signaling agent has substantially reduced or ablated affinity and/or activity for TGFBR1 and/or TGFBR2. In some embodiments, the modified signaling agent optionally has reduced or substantially reduced or ablated affinity and/or activity for TGFBR3 which, without wishing to be bound by theory, may act as a reservoir of ligand for TGF-beta receptors. In some embodiments, the TGFβ may favor TGFBR1 over TGFBR2 or TGFBR2 over TGFBR1. Similarly, LAP, without wishing to be bound by theory, may act as a reservoir of ligand for TGF-beta receptors. In some embodiments, the modified signaling agent has reduced affinity and/or activity for TGFBR1 and/or TGFBR2 and/or substantially reduced or ablated affinity and/or activity for Latency Associated Peptide (LAP). In some embodiments, such chimeras find use in Camurati-Engelmann disease, or other diseases associated with inappropriate TGFβ signaling.

In some embodiments, the additional modified agent is a TGF family member (e.g., TGFα, TGFβ) which has reduced affinity and/or activity, i.e., antagonistic activity (e.g., natural antagonistic activity or antagonistic activity that is the result of one or more mutations, see, e.g., WO 2015/007520, the entire contents of which are hereby incorporated by reference) at one or more of TGFBR1, TGFBR2, TGFBR3. In these embodiments, the modified agent is a TGF family member (e.g., TGFα, TGFβ) which also, optionally, has substantially reduced or ablated affinity and/or activity at one or more of TGFBR1, TGFBR2, TGFBR3.

In some embodiments, the additional modified agent is a TGF family member (e.g., TGFα, TGFβ) which has reduced affinity and/or activity, i.e., antagonistic activity (e.g., natural antagonistic activity or antagonistic activity that is the result of one or more mutations, see, e.g., WO 2015/007520, the entire contents of which are hereby incorporated by reference) at TGFBR1 and/or TGFBR2. In these embodiments, the modified agent is a TGF family member (e.g., TGFα, TGFβ) which also, optionally, has substantially reduced or ablated affinity and/or activity at TGFBR3.

In an embodiment, the additional modified signaling agent is IL-1. In an embodiment, the modified signaling agent is IL-1α or IL-1β. In some embodiments, the modified signaling agent has reduced affinity and/or activity for IL-1R1 and/or IL-1RAcP. In some embodiments, the modified signaling agent has substantially reduced or ablated affinity and/or activity for IL-1R1 and/or IL-1RAcP. In some embodiments, the modified signaling agent has reduced affinity and/or activity for IL-1R2. In some embodiments, the modified signaling agent has substantially reduced or ablated affinity and/or activity for IL-1R2. For instance, in some embodiments, the present modified IL-1 agents avoid interaction at IL-1R2 and therefore substantially reduce its function as a decoy and/or sink for therapeutic agents.

In an embodiment, the wild type IL-1β has the amino acid sequence of SEQ ID NO: 242.

IL1 is a proinflammatory cytokine and an important immune system regulator. It is a potent activator of CD4 T cell responses, increases proportion of Th17 cells and expansion of IFN-γ and IL-4 producing cells. IL-1 is also a potent regulator of CD8$^+$ T cells, enhancing antigen-specific CD8$^+$ T cell expansion, differentiation, migration to periphery and memory. IL-1 receptors comprise IL-1R1 and IL-1R2. Binding to and signaling through the IL-1R1 constitutes the mechanism whereby IL-1 mediates many of its biological (and pathological) activities. IL1-R2 can function as a decoy receptor, thereby reducing IL-1 availability for interaction and signaling through the IL-1R1.

In some embodiments, the modified IL-1 has reduced affinity and/or activity (e.g., agonistic activity) for IL-1R1. In some embodiments, the modified IL-1 has substantially reduced or ablated affinity and/or activity for IL-1R2. In such embodiments, there is restorable IL-1/IL-1R1 signaling and prevention of loss of therapeutic chimeras at IL-R2 and therefore a reduction in dose of IL-1 that is required (e.g., relative to wild type or a chimera bearing only an attenuation mutation for IL-R1). Such constructs find use in, for example, methods of treating cancer, including, for example, stimulating the immune system to mount an anti-cancer response.

In some embodiments, the modified IL-1 has reduced affinity and/or activity (e.g., antagonistic activity, e.g., natural antagonistic activity or antagonistic activity that is the result of one or more mutations, see, e.g., WO 2015/007520, the entire contents of which are hereby incorporated by reference) for IL-1R1. In some embodiments, the modified IL-1 has substantially reduced or ablated affinity and/or activity for IL-1R2. In such embodiments, there is the IL-1/IL-1R1 signaling is not restorable and prevention of loss of therapeutic chimeras at IL-R2 and therefore a reduction in dose of IL-1 that is required (e.g., relative to wild type or a chimera bearing only an attenuation mutation for IL-R1). Such constructs find use in, for example, methods of treating autoimmune diseases, including, for example, suppressing the immune system.

In such embodiments, the modified signaling agent has a deletion of amino acids 52-54 which produces a modified human IL-1β with reduced binding affinity for type I IL-1R and reduced biological activity. See, for example, WO 1994/000491, the entire contents of which are hereby incorporated by reference. In some embodiments, the modified human IL-1β has one or more substitution mutations selected from A117G/P118G, R120X, L122A, T125G/L126G, R127G, Q130X, Q131G, K132A, S137G/Q138Y, L145G, H146X, L145A/L147A, Q148X, Q148G/Q150G, Q150G/D151A, M152G, F162A, F162A/Q164E, F166A, Q164E/E167K, N169G/D170G, I172A, V174A, K208E, K209X, K209A/K210A, K219X, E221X, E221 S/N224A, N224S/K225S, E244K, N245Q (where X can be any change in amino acid, e.g., a non-conservative change), which exhibit reduced binding to IL-1R, as described, for example, in WO2015/007542 and WO/2015/007536, the entire contents of which is hereby incorporated by reference (numbering base on the human IL-1 β sequence, Genbank accession number NP_000567, version NP-000567.1, GI: 10835145). In some embodiments, the modified human IL-1β may have one or more mutations selected from R120A, R120G, Q130A, Q130W, H146A, H146G, H146E, H146N, H146R, Q148E, Q148G, Q148L, K209A, K209D, K219S, K219Q, E221S and E221K. In an embodiment, the modified human IL-1β comprises the mutations Q131G and Q148G. In an embodiment, the modified human IL-1β comprises the mutations Q148G and K208E. In an embodiment, the modified human IL-1β comprises the mutations R120G and Q131G. In an embodiment, the modified human IL-1β comprises the mutations R120G and H146G. In an embodiment, the modified human IL-1β comprises the mutations R120G and K208E. In an embodiment, the modified human IL-1β comprises the mutations R120G, F162A, and Q164E.

In an embodiment, the additional modified signaling agent is IL-2. In such an embodiment, the modified signaling agent has reduced affinity and/or activity for IL-2Rα and/or IL-2Rβ and/or IL-2Rγ. In some embodiments, the modified signaling agent has reduced affinity and/or activity for IL-2Rβ and/or IL-2Rγ. In some embodiments, the modified signaling agent has substantially reduced or ablated affinity and/or activity for IL-2Rα. Such embodiments may be relevant for treatment of cancer, for instance when the modified IL-2 is agonistic at IL-2Rβ and/or IL-2Rγ. For instance, the present constructs may favor attenuated activation of CD8+ T cells (which can provide an anti-tumor effect), which have IL2 receptors β and γ and disfavor $T_{regs}$ (which can provide an immune suppressive, pro-tumor effect), which have IL2 receptors α, β, and γ. Further, in some embodiments, the preferences for IL-2Rβ and/or IL-2Rγ over IL-2Rα avoid IL-2 side effects such as pulmonary edema. Also, IL-2-based chimeras are useful for the treatment of autoimmune diseases, for instance when the modified IL-2 is antagonistic (e.g., natural antagonistic activity or antagonistic activity that is the result of one or more mutations, see, e.g., WO 2015/007520, the entire contents of which are hereby incorporated by reference) at IL-2Rβ and/or IL-2Rγ. For instance, the present constructs may favor attenuated suppression of CD8+ T cells (and therefore dampen the immune response), which have IL2 receptors β and γ and disfavor $T_{regs}$ which have IL2 receptors α, β, and γ. Alternatively, in some embodiments, the chimeras bearing IL-2 favor the activation of $T_{regs}$, and therefore immune suppression, and activation of disfavor of CD8+ T cells. For instance, these constructs find use in the treatment of diseases or diseases that would benefit from immune suppression, e.g., autoimmune disorders.

In some embodiments, the chimeric protein has targeting moieties as described herein directed to CD8+ T cells as well as a modified IL-2 agent having reduced affinity and/or activity for IL-2Rβ and/or IL-2Rγ and/or substantially reduced or ablated affinity and/or activity for IL-2Rα. In some embodiments, these constructs provide targeted CD8+ T cell activity and are generally inactive (or have substantially reduced activity) towards $T_{reg}$ cells. In some embodiments, such constructs have enhanced immune stimulatory effect compared to wild type IL-2 (e.g., without wishing to be bound by theory, by not stimulating Tregs), whilst eliminating or reducing the systemic toxicity associated with IL-2.

In an embodiment, the wild type IL-2 has the amino acid sequence of SEQ ID NO: 243.

In such embodiments, the modified IL-2 agent has one or more mutations at amino acids L72 (L72G, L72A, L72S, L72T, L72Q, L72E, L72N, L72D, L72R, or L72K), F42 (F42A, F42G, F42S, F42T, F42Q, F42E, F42N, F42D, F42R, or F42K) and Y45 (Y45A, Y45G, Y45S, Y45T, Y45Q, Y45E, Y45N, Y45D, Y45R or Y45K). Without wishing to be bound by theory, it is believed that these modified IL-2 agents have reduced affinity for the high-affinity IL-2 receptor and preserves affinity to the intermediate-affinity IL-2 receptor, as compared to the wild type IL-2. See, for example, US Patent Publication No. 2012/0244112, the entire contents of which are hereby incorporated by reference.

In an embodiment, the additional modified signaling agent is IL-3. In some embodiments, the modified signaling agent has reduced affinity and/or activity for the IL-3 receptor, which is a heterodimer with a unique alpha chain paired with the common beta (beta c or CD131) subunit. In some embodiments, the modified signaling agent has substantially reduced or ablated affinity and/or activity for the IL-3 receptor, which is a heterodimer with a unique alpha chain paired with the common beta (beta c or CD131) subunit.

In an embodiment, the additional modified signaling agent is IL-4. In such an embodiment, the modified signaling agent has reduced affinity and/or activity for type 1 and/or type 2 IL-4 receptors. In such an embodiment, the modified signaling agent has substantially reduced or ablated affinity and/or activity for type 1 and/or type 2 IL-4 receptors. Type 1 IL-4 receptors are composed of the IL-4Rα subunit with a common γ chain and specifically bind IL-4. Type 2 IL-4 receptors include an IL-4Rα subunit bound to a different subunit known as IL-13Rα1. In some embodiments, the modified signaling agent has substantially reduced or ablated affinity and/or activity the type 2 IL-4 receptors.

In an embodiment, the wild type IL-4 has the amino acid sequence of SEQ ID NO: 244.

In such embodiments, the modified IL-4 agent has one or more mutations at amino acids R121 (R121A, R121D, R121E, R121F, R121H, R121I, R121K, R121N, R121P, R121T, R121W), E122 (E122F), Y124 (Y124A, Y124Q, Y124R, Y124S, Y124T) and S125 (S125A). Without wishing to be bound by theory, it is believed that these modified IL-4 agents maintain the activity mediated by the type I receptor, but significantly reduces the biological activity mediated by the other receptors. See, for example, U.S. Pat. No. 6,433,157, the entire contents of which are hereby incorporated by reference.

In an embodiment, the additional modified signaling agent is IL-6. IL-6 signals through a cell-surface type I cytokine receptor complex including the ligand-binding IL-6R chain (CD126), and the signal-transducing component gp130. IL-6 may also bind to a soluble form of IL-6R (sIL-6R), which is the extracellular portion of IL-6R. The sIL-6R/IL-6 complex may be involved in neurites outgrowth and survival of neurons and, hence, may be important in nerve regeneration through remyelination. Accordingly, in some embodiments, the modified signaling agent has reduced affinity and/or activity for IL-6R/gp130 and/or sIL-6R. In some embodiments, the modified signaling agent has substantially reduced or ablated affinity and/or activity for IL-6R/gp130 and/or sIL-6R.

In an embodiment, the wild type IL-6 has the amino acid sequence of SEQ ID NO: 245.

In such embodiments, the modified signaling agent has one or more mutations at amino acids 58, 160, 163, 171 or 177. Without wishing to be bound by theory, it is believed that these modified IL-6 agents exhibit reduced binding affinity to IL-6Ralpha and reduced biological activity. See, for example, WO 97/10338, the entire contents of which are hereby incorporated by reference.

In an embodiment, the additional modified signaling agent is IL-10. In such an embodiment, the modified signaling agent has reduced affinity and/or activity for IL-10 receptor-1 and IL-10 receptor-2. In some embodiments, the modified signaling agent has substantially reduced or ablated affinity and/or activity for IL-10 receptor-1 and IL-10 receptor-2

In an embodiment, the additional modified signaling agent is IL-11. In such an embodiment, the modified signaling agent has reduced affinity and/or activity for IL-11Rα and/or IL-11Rβ and/or gp130. In such an embodiment, the modified signaling agent has substantially reduced or ablated affinity and/or activity for IL-11Rα and/or IL-11Rβ and/or gp130.

In an embodiment, the additional modified signaling agent is IL-12. In such an embodiment, the modified signaling agent has reduced affinity and/or activity for IL-12Rβ1 and/or IL-12Rβ2. In such an embodiment, the modified signaling agent has substantially reduced or ablated affinity and/or activity for IL-12Rβ1 and/or IL-12Rβ2.

In an embodiment, the additional modified signaling agent is IL-13. In such an embodiment, the modified signaling agent has reduced affinity and/or activity for the IL-4 receptor (IL-4Rα) and IL-13Rα1. In some embodiments, the modified signaling agent has substantially reduced or ablated affinity and/or activity for IL-4 receptor (IL-4Rα) or IL-13Rα1.

In an embodiment, the wild type IL-13 has the amino acid sequence of SEQ ID NO: 246.

In such embodiments, the modified IL-13 agent has one or more mutations at amino acids 13, 16, 17, 66, 69, 99, 102, 104, 105, 106, 107, 108, 109, 112, 113 and 114. Without wishing to be bound by theory, it is believed that these modified IL-13 agents exhibit reduced biological activity. See, for example, WO 2002/018422, the entire contents of which are hereby incorporated by reference.

In an embodiment, the additional modified signaling agent is IL-18. In some embodiments, the modified signaling agent has reduced affinity and/or activity for IL-18Rα and/or IL-18Rβ. In some embodiments, the modified signaling agent has substantially reduced or ablated affinity and/or activity for IL-18Rα and/or IL-18Rβ. In some embodiments, the modified signaling agent has substantially reduced or ablated affinity and/or activity for IL-18Rα type II, which is an isoform of IL-18Rα that lacks the TIR domain required for signaling.

In an embodiment, the wild type IL-18 has the amino acid sequence of SEQ ID NO: 247.

In such embodiments, the modified IL-18 agent may comprise one or more mutations in amino acids or amino acid regions selected from Y37-K44, R49-Q54, D59-R63, E67-C74, R80, M87-A97, N 127-K129, Q139-M149, K165-K171, R183 and Q190-N191, as described in WO/2015/007542, the entire contents of which are hereby incorporated by reference (numbering based on the human IL-18 sequence, Genbank accession number AAV38697, version AAV38697.1, GI: 54696650).

In an embodiment, the additional modified signaling agent is IL-33. In such an embodiment, the modified signaling agent has reduced affinity and/or activity for the ST-2 receptor and IL-1RAcP. In some embodiments, the modified signaling agent has substantially reduced or ablated affinity and/or activity for the ST-2 receptor and IL-1RAcP.

In an embodiment, the wild type IL-33 has the amino acid sequence of SEQ ID NO: 248.

In such embodiments, the modified IL-33 agent may comprise one or more mutations in amino acids or amino acid regions selected from I113-Y122, S127-E139, E144-D157, Y163-M183, E200, Q215, L220-C227 and T260-E269, as described in WO/2015/007542, the entire contents of which are hereby incorporated by reference (numbering based on the human sequence, Genbank accession number NP_254274, version NP_254274.1, GI:15559209).

In an embodiment, the modified signaling agent is epidermal growth factor (EGF). EGF is a member of a family of potent growth factors. Members include EGF, HB-EGF, and others such as TGFalpha, amphiregulin, neuregulins, epiregulin, betacellulin. EGF family receptors include EGFR (ErbB1), ErbB2, ErbB3 and ErbB4. These may function as homodimeric and/or heterodimeric receptor subtypes. The different EGF family members exhibit differential selectivity for the various receptor subtypes. For example, EGF associates with ErbB1/ErbB1, ErbB1/ErbB2, ErbB4/ErbB2 and some other heterodimeric subtypes. HB-EGF has a similar pattern, although it also associates with ErbB4/4. Modulation of EGF (EGF-like) growth factor signaling, positively or negatively, is of considerable therapeutic interest. For example, inhibition of EGFRs signaling is of interest in the treatment of various cancers where EGFR signaling constitutes a major growth promoting signal. Alternatively, stimulation of EGFRs signaling is of therapeutic interest in, for example, promoting wound healing (acute and chronic), oral mucositis (a major side-effect of various cancer therapies, including, without limitation radiation therapy).

In some embodiments, the additional modified signaling agent has reduced affinity and/or activity for ErbB1, ErbB2, ErbB3, and/or ErbB4. Such embodiments find use, for example, in methods of treating wounds. In some embodiments, the modified signaling agent binds to one or more ErbB1, ErbB2, ErbB3, and ErbB4 and antagonizes the activity of the receptor. In such embodiments, the modified signaling agent has reduced affinity and/or activity for ErbB1, ErbB2, ErbB3, and/or ErbB4 which allows for the activity of the receptor to be antagonized in an attenuated fashion. Such embodiments find use in, for example, treatments of cancer. In an embodiment, the modified signaling agent has reduced affinity and/or activity for ErbB1. ErbB1 is the therapeutic target of kinase inhibitors—most have side effects because they are not very selective (e.g., gefitinib, erlotinib, afatinib, brigatinib and icotinib). In some embodiments, attenuated antagonistic ErbB1 signaling is more on-target and has less side effects than other agents targeting receptors for EGF.

In some embodiments, the additional modified signaling agent has reduced affinity and/or activity (e.g., antagonistic e.g., natural antagonistic activity or antagonistic activity that is the result of one or more mutations, see, e.g., WO 2015/007520, the entire contents of which are hereby incorporated by reference) for ErbB1 and/or substantially reduced or ablated affinity and/or activity for ErbB4 or other subtypes it may interact with. Through specific targeting via the targeting moiety, cell-selective suppression (antagonism e.g., natural antagonistic activity or antagonistic activity that is the result of one or more mutations, see, e.g., WO 2015/007520, the entire contents of which are hereby incorporated by reference) of ErbB1/ErbB1 receptor activation would be achieved—while not engaging other receptor subtypes potentially associated with inhibition-associated side effects. Hence, in contrast to EGFR kinase inhibitors, which inhibit EGFR activity in all cell types in the body, such a construct would provide a cell-selective (e.g., tumor cell with activated EGFR signaling due to amplification of receptor, overexpression etc.) anti-EGFR (ErbB1) drug effect with reduced side effects.

In some embodiments, the additional modified signaling agent has reduced affinity and/or activity (e.g., agonistic) for ErbB4 and/or other subtypes it may interact with. Through targeting to specific target cells through the targeting moiety, a selective activation of ErbB1 signaling is achieved (e.g., epithelial cells). Such a construct finds use, in some embodiments, in the treatment of wounds (promoting would healing) with reduced side effects, especially for treatment of chronic conditions and application other than topical application of a therapeutic (e.g., systemic wound healing).

In an embodiment, the modified signaling agent is insulin or insulin analogs. In some embodiments, the modified insulin or insulin analog has reduced affinity and/or activity for the insulin receptor and/or IGF1 or IGF2 receptor. In some embodiments, the modified insulin or insulin analog has substantially reduced or ablated affinity and/or activity for the insulin receptor and/or IGF1 or IGF2 receptor. Attenuated response at the insulin receptor allows for the control of diabetes, obesity, metabolic disorders and the like while directing away from IGF1 or IGF2 receptor avoids pro-cancer effects.

In an embodiment, the modified signaling agent is insulin-like growth factor-I or insulin-like growth factor-II (IGF-1 or IGF-2). In an embodiment, the modified signaling agent is IGF-1. In such an embodiment, the modified signaling agent has reduced affinity and/or activity for the insulin receptor and/or IGF1 receptor. In an embodiment, the modified signaling agent may bind to the IGF1 receptor and antagonize the activity of the receptor. In such an embodiment, the modified signaling agent has reduced affinity and/or activity for IGF1 receptor which allows for the activity of the receptor to be antagonized in an attenuated fashion. In some embodiments, the modified signaling agent has substantially reduced or ablated affinity and/or activity for the insulin receptor and/or IGF1 receptor. In some embodiments, the modified signaling agent has reduced affinity and/or activity for IGF2 receptor which allows for the activity of the receptor to be antagonized in an attenuated fashion. In an embodiment, the modified signaling agent has substantially reduced or ablated affinity and/or activity for the insulin receptor and accordingly does not interfere with insulin signaling. In various embodiments, this applies to cancer treatment. In various embodiments, the present agents may prevent IR isoform A from causing resistance to cancer treatments.

In an embodiment, the modified signaling agent is EPO. In various embodiments, the modified EPO agent has reduced affinity and/or activity for the EPO receptor (EPOR) receptor and/or the ephrin receptor (EphR) relative to wild type EPO or other EPO based agents described herein. In some embodiments, the modified EPO agent has substantially reduced or ablated affinity and/or activity for the EPO receptor (EPOR) receptor and/or the Eph receptor (EphR). Illustrative EPO receptors include, but are not limited to, an EPOR homodimer or an EPOR/CD131 heterodimer. Also included as an EPO receptor is beta-common receptor ($\beta$cR). Illustrative Eph receptors include, but are not limited to, EPHA1, EPHA2, EPHA3, EPHA4, EPHA5, EPHA6, EPHA7, EPHA8, EPHA9, EPHA10, EPHB1, EPHB2, EPHB3, EPHB4, EPHB5, and EPHB6. In some embodiments, the modified EPO protein comprises one or more mutations that cause the EPO protein to have reduced affinity for receptors that comprise one or more different EPO receptors or Eph receptors (e.g., heterodimer, heterotrimers, etc., including by way of non-limitation: EPOR-EPHB4, EPOR-$\beta$cR-EPOR). Also provided are the receptors of EP Patent Publication No. 2492355 the entire contents of which are hereby incorporated by reference, including by way of non-limitation, NEPORs.

In an embodiment, the human EPO has the amino acid sequence of SEQ ID NO: 249, in which the signal peptide comprises the first 27 amino acids.

In an embodiment, the human EPO protein is the mature form of EPO (with the signal peptide being cleaved off) which is a glycoprotein of 166 amino acid residues having the sequence of SEQ ID NO: 250.

The structure of the human EPO protein is predicted to comprise four-helix bundles including helices A, B, C, and D. In various embodiments, the modified EPO protein comprises one or more mutations located in four regions of the EPO protein which are important for bioactivity, i.e., amino acid residues 10-20, 44-51, 96-108, and 142-156. In some embodiments, the one or more mutations are located at residues 11-15, 44-51, 100-108, and 147-151. These residues are localized to helix A (Val11, Arg14, and Tyr15), helix C (Ser100, Arg103, Ser104, and Leu108), helix D (Asn147, Arg150, Gly151, and Leu155), and the A/B connecting loop (residues 42-51). In some embodiments, the modified EPO protein comprises mutations in residues between amino acids 41-52 and amino acids 147, 150, 151, and 155. Without wishing to be bound by theory, it is believed that mutations of these residues have substantial effects on both receptor binding and in vitro biological activity. In some embodiments, the modified EPO protein comprises mutations at residues 11, 14, 15, 100, 103, 104, and 108. Without wishing to be bound by theory, it is believed that mutations of these residues have modest effects on receptor binding activity and much greater effects on in vitro biological activity. Illustrative substitutions include, but are not limited to, one or more of Val11Ser, Arg14Ala, Arg14Gln, Tyr15Ile, Pro42Asn, Thr44Ile, Lys45Asp, Val46Ala, Tyr51Phe, Ser100Glu, Ser100Thr, Arg103Ala, Ser104Ile, Ser104Ala, Leu108Lys, Asn147Lys, Arg150Ala, Gly151Ala, and Leu155Ala.

In some embodiments, the modified EPO protein comprises mutations that effect bioactivity and not binding, e.g., those listed in Eliot, et al. Mapping of the Active Site of Recombinant Human Erythropoietin Jan. 15, 1997; *Blood:* 89 (2), the entire contents of which are hereby incorporated by reference.

In some embodiments, the modified EPO protein comprises one or more mutations involving surface residues of the EPO protein which are involved in receptor contact. Without wishing to be bound by theory, it is believed that mutations of these surface residues are less likely to affect protein folding thereby retaining some biological activity. Illustrative surface residues that may be mutated include, but are not limited to, residues 147 and 150. In illustrative embodiments, the mutations are substitutions including, one or more of N147A, N147K, R150A and R150E.

In some embodiments, the modified EPO protein comprises one or more mutations at residues N59, E62, L67, and L70, and one or more mutations that affect disulfide bond formation. Without wishing to be bound by theory, it is believed that these mutations affect folding and/or are predicted be in buried positions and thus affects biological activity indirectly.

In an embodiment, the modified EPO protein comprises a K20E substitution which significantly reduces receptor binding. See Elliott, et al., (1997) *Blood,* 89:493-502, the entire contents of which are hereby incorporated by reference.

Additional EPO mutations that may be incorporated into the chimeric EPO protein of the invention are disclosed in, for example, Elliott, et al., (1997) *Blood,* 89:493-502, the entire contents of which are hereby incorporated by reference and Taylor et al., (2010) *PEDS,* 23(4): 251-260, the entire contents of which are hereby incorporated by reference.

In various embodiments, the signaling agent is a toxin or toxic enzyme. In some embodiments, the toxin or toxic enzyme is derived from plants and bacteria. Illustrative toxins or toxic enzymes include, but are not limited to, the diphtheria toxin, Pseudomonas toxin, anthrax toxin, ribosome-inactivating proteins (RIPs) such as ricin and saporin, modeccin, abrin, gelonin, and poke weed antiviral protein. Additional toxins include those disclosed in Mathew et al., (2009) Cancer Sci 100(8): 1359-65, the entire disclosures are hereby incorporated by reference. In such embodiments, the chimeric proteins of the invention may be utilized to induce cell death in cell-type specific manner. In such embodiments, the toxin may be modified, e.g., mutated, to reduce affinity and/or activity of the toxin for an attenuated effect, as described with other signaling agents herein.

Linkers

In some embodiments, the present chimeric protein optionally comprises one or more linkers. In some embodiments, the present chimeric protein comprises a linker connecting the targeting moiety and the signaling agent (e.g., modified IFN-γ). In some embodiments, the present chimeric protein comprises a linker within the signaling agent (e.g., modified IFN-γ).

In some embodiments vectors encoding the present chimeric proteins linked as a single nucleotide sequence to any of the linkers described herein are provided and may be used to prepare such chimeric proteins.

In some embodiments, the linker length allows for efficient binding of a targeting moiety and the signaling agent (e.g., modified IFN-γ) to their receptors. For instance, in some embodiments, the linker length allows for efficient binding of one of the targeting moieties and the signaling agent to receptors on the same cell.

In some embodiments the linker length is at least equal to the minimum distance between the binding sites of one of the targeting moieties and the signaling agent to receptors on the same cell. In some embodiments the linker length is at least twice, or three times, or four times, or five times, or ten times, or twenty times, or 25 times, or 50 times, or one hundred times, or more the minimum distance between the binding sites of one of the targeting moieties and the signaling agent to receptors on the same cell.

As described herein, the linker length allows for efficient binding of one of the targeting moieties and the signaling agent to receptors on the same cell, the binding being sequential, e.g., targeting moiety/receptor binding preceding signaling agent/receptor binding.

In some embodiments, there are two linkers in a single chimera, each connecting the signaling agent to a targeting moiety. In various embodiments, the linkers have lengths that allow for the formation of a site that has a disease cell and an effector cell without steric hindrance that would prevent modulation of the either cell.

The invention contemplates the use of a variety of linker sequences. In various embodiments, the linker may be derived from naturally-occurring multi-domain proteins or are empirical linkers as described, for example, in Chichili et al., (2013), Protein Sci. 22(2):153-167, Chen et al., (2013), Adv Drug Deliv Rev. 65(10):1357-1369, the entire contents of which are hereby incorporated by reference. In some embodiments, the linker may be designed using linker designing databases and computer programs such as those described in Chen et al., (2013), Adv Drug Deliv Rev. 65(10):1357-1369 and Crasto et al., (2000), Protein Eng. 13(5):309-312, the entire contents of which are hereby incorporated by reference. In various embodiments, the linker may be functional. For example, without limitation, the linker may function to improve the folding and/or stability, improve the expression, improve the pharmacokinetics, and/or improve the bioactivity of the present chimeric protein.

In some embodiments, the linker is a polypeptide. In some embodiments, the linker is less than about 100 amino acids long. For example, the linker may be less than about 100, about 95, about 90, about 85, about 80, about 75, about 70, about 65, about 60, about 55, about 50, about 45, about 40, about 35, about 30, about 25, about 20, about 19, about 18, about 17, about 16, about 15, about 14, about 13, about 12, about 11, about 10, about 9, about 8, about 7, about 6, about 5, about 4, about 3, or about 2 amino acids long. In some embodiments, the linker is a polypeptide. In some embodiments, the linker is greater than about 100 amino acids long. For example, the linker may be greater than about 100, about 95, about 90, about 85, about 80, about 75, about 70, about 65, about 60, about 55, about 50, about 45, about 40, about 35, about 30, about 25, about 20, about 19, about 18, about 17, about 16, about 15, about 14, about 13, about 12, about 11, about 10, about 9, about 8, about 7, about 6, about 5, about 4, about 3, or about 2 amino acids long. In some embodiments, the linker is flexible. In another embodiment, the linker is rigid.

In some embodiments directed to chimeric proteins having two or more targeting moieties, a linker connects the two targeting moieties to each other and this linker has a short length and a linker connects a targeting moiety and a signaling agent this linker is longer than the linker connecting the two targeting moieties. For example, the difference in amino acid length between the linker connecting the two targeting moieties and the linker connecting a targeting moiety and a signaling agent may be about 100, about 95, about 90, about 85, about 80, about 75, about 70, about 65, about 60, about 55, about 50, about 45, about 40, about 35, about 30, about 25, about 20, about 19, about 18, about 17, about 16, about 15, about 14, about 13, about 12, about 11, about 10, about 9, about 8, about 7, about 6, about 5, about 4, about 3, or about 2 amino acids.

In various embodiments, the linker is substantially comprised of glycine and serine residues (e.g., about 30%, or about 40%, or about 50%, or about 60%, or about 70%, or about 80%, or about 90%, or about 95%, or about 97% glycines and serines). For example, in some embodiments, the linker is (Gly4Ser)n, where n is from about 1 to about 8, e.g., 1, 2, 3, 4, 5, 6, 7, or 8. In an embodiment, the linker sequence is GGSGGSGGGGSGGGGS (SEQ ID NO: 251). Additional illustrative linkers include, but are not limited to, linkers having the sequence LE, GGGGS (SEQ ID NO: 252), (GGGGS)n (n=1-4; SEQ ID NO: 253), GGGGGGGG (SEQ ID NO: 254), GGGGGG (SEQ ID NO: 255), (EAAAK)n (n=1-3; SEQ ID NO: 256), A(EAAAK)nA (n=2-5; SEQ ID NO: 257), AEAAAKEAAAKA (SEQ ID NO: 258), A(EAAAK)$_4$ALEA(EAAAK)$_4$A (SEQ ID NO: 259), PAPAP (SEQ ID NO: 260), KESGSVSSEQLAQFRSLD (SEQ ID NO: 261), EGKSSGSGSESKST (SEQ ID NO: 262), GSAGSAAGSGEF(SEQ ID NO: 263), and (XP)n, with X designating any amino acid, e.g., Ala, Lys, or Glu. In various embodiments, the linker is GGS.

In some embodiments, the linker is one or more of GGGSE (SEQ ID NO: 942), GSESG (SEQ ID NO: 943), GSEGS (SEQ ID NO: 944), GEGGSGEGSSGEGSSSEGGGSEGGGSEGGGSEGGS (SEQ ID NO: 945), and a linker of randomly placed G, S, and E every 4 amino acid intervals.

In some embodiments, the linker is a hinge region of an antibody (e.g., of IgG, IgA, IgD, and IgE, inclusive of subclasses (e.g., IgG1, IgG2, IgG3, and IgG4, and IgA1 and IgA2)). In various embodiments, the linker is a hinge region of an antibody (e.g., of IgG, IgA, IgD, and IgE, inclusive of subclasses (e.g., IgG1, IgG2, IgG3, and IgG4, and IgA1 and IgA2)). The hinge region, found in IgG, IgA, IgD, and IgE class antibodies, acts as a flexible spacer, allowing the Fab portion to move freely in space. In contrast to the constant regions, the hinge domains are structurally diverse, varying in both sequence and length among immunoglobulin classes and subclasses. For example, the length and flexibility of the hinge region varies among the IgG subclasses. The hinge region of IgG1 encompasses amino acids 216-231 and, because it is freely flexible, the Fab fragments can rotate about their axes of symmetry and move within a sphere centered at the first of two inter-heavy chain disulfide bridges. IgG2 has a shorter hinge than IgG1, with 12 amino acid residues and four disulfide bridges. The hinge region of IgG2 lacks a glycine residue, is relatively short, and contains a rigid poly-proline double helix, stabilized by extra inter-heavy chain disulfide bridges. These properties restrict the flexibility of the IgG2 molecule. IgG3 differs from the other subclasses by its unique extended hinge region (about four times as long as the IgG1 hinge), containing 62 amino acids (including 21 prolines and 11 cysteines), forming an inflexible poly-proline double helix. In IgG3, the Fab fragments are relatively far away from the Fc fragment, giving the molecule a greater flexibility. The elongated hinge in IgG3 is also responsible for its higher molecular weight compared to the other subclasses. The hinge region of IgG4 is shorter than that of IgG1 and its flexibility is intermediate between that of IgG1 and IgG2. The flexibility of the hinge regions reportedly decreases in the order IgG3>IgG1>IgG4>IgG2.

According to crystallographic studies, the immunoglobulin hinge region can be further subdivided functionally into three regions: the upper hinge region, the core region, and the lower hinge region. See Shin et al., 1992 Immunological Reviews 130:87. The upper hinge region includes amino acids from the carboxyl end of $C_{H1}$ to the first residue in the hinge that restricts motion, generally the first cysteine residue that forms an interchain disulfide bond between the two heavy chains. The length of the upper hinge region correlates with the segmental flexibility of the antibody. The core hinge region contains the inter-heavy chain disulfide bridges, and the lower hinge region joins the amino terminal end of the $C_{H2}$ domain and includes residues in $C_{H2}$. Id. The core hinge region of wild type human IgG1 contains the sequence Cys-Pro-Pro-Cys which, when dimerized by disulfide bond formation, results in a cyclic octapeptide believed to act as a pivot, thus conferring flexibility. In various embodiments, the present linker comprises, one, or two, or three of the upper hinge region, the core region, and the lower hinge region of any antibody (e.g., of IgG, IgA, IgD, and IgE, inclusive of subclasses (e.g., IgG1, IgG2, IgG3, and IgG4, and IgA1 and IgA2)). The hinge region may also contain one or more glycosylation sites, which include a number of structurally distinct types of sites for carbohydrate attachment. For example, IgA1 contains five glycosylation sites within a 17-amino-acid segment of the hinge region, conferring resistance of the hinge region polypeptide to intestinal proteases, considered an advantageous property for a secretory immunoglobulin. In various embodiments, the linker of the present invention comprises one or more glycosylation sites. In various embodiments, the linker is a hinge-CH2-CH3 domain of a human IgG4 antibody.

If desired, the present chimeric protein can be linked to an antibody Fc region, comprising one or both of $C_H2$ and $C_H3$ domains, and optionally a hinge region. For example, vectors encoding the present chimeric proteins linked as a single nucleotide sequence to an Fc region can be used to prepare such polypeptides.

In some embodiments, the linker is a synthetic linker such as PEG.

In various embodiments, the linker may be functional. For example, without limitation, the linker may function to improve the folding and/or stability, improve the expression, improve the pharmacokinetics, and/or improve the bioactivity of the present chimeric protein. In another example, the linker may function to target the chimeric protein to a particular cell type or location.

In various embodiments, each of the chimeric proteins may by conjugated and/or fused with another agent to extend half-life or otherwise improve pharmacodynamic and pharmacokinetic properties. In some embodiments, the chimeric proteins may be fused or conjugated with one or more of PEG, XTEN (e.g., as rPEG), polysialic acid (POLYXEN), albumin (e.g., human serum albumin or HAS), elastin-like protein (ELP), PAS, HAP, GLK, CTP, transferrin, and the like. In some embodiments, the chimeric protein may be fused or conjugated with an antibody or an antibody fragment such as an Fc fragment. For example, the chimeric protein may be fused to either the N-terminus or the C-terminus of the Fc domain of human immunoglobulin (Ig) G. In various embodiments, each of the individual chimeric proteins is fused to one or more of the agents described in BioDrugs (2015) 29:215-239, the entire contents of which are hereby incorporated by reference.

Production of Chimeric Proteins

Methods for producing the chimeric proteins of the invention are described herein. For example, DNA sequences encoding the chimeric proteins of the invention (e.g., DNA sequences encoding the modified signaling agent (e.g., modified IFN-β) and the targeting moiety and the linker) can be chemically synthesized using methods known in the art. Synthetic DNA sequences can be ligated to other appropriate nucleotide sequences, including, e.g., expression control sequences, to produce gene expression constructs encoding the desired chimeric proteins. Accordingly, in various embodiments, the present invention provides for isolated nucleic acids comprising a nucleotide sequence encoding the chimeric protein of the invention.

Nucleic acids encoding the chimeric protein of the invention can be incorporated (ligated) into expression vectors, which can be introduced into host cells through transfection, transformation, or transduction techniques. For example, nucleic acids encoding the chimeric protein of the invention can be introduced into host cells by retroviral transduction. Illustrative host cells are E. coli cells, Chinese hamster ovary (CHO) cells, human embryonic kidney 293 (HEK 293) cells, HeLa cells, baby hamster kidney (BHK) cells, monkey kidney cells (COS), human hepatocellular carcinoma cells (e.g., Hep G2), and myeloma cells. Transformed host cells can be grown under conditions that permit the host cells to express the genes that encode the chimeric protein of the invention. Accordingly, in various embodiments, the present invention provides expression vectors comprising nucleic acids that encode the chimeric protein of the invention. In various embodiments, the present invention additional provides host cells comprising such expression vectors.

Specific expression and purification conditions will vary depending upon the expression system employed. For example, if a gene is to be expressed in E. coli, it is first cloned into an expression vector by positioning the engineered gene downstream from a suitable bacterial promoter, e.g., Trp or Tac, and a prokaryotic signal sequence. In another example, if the engineered gene is to be expressed in eukaryotic host cells, e.g., CHO cells, it is first inserted into an expression vector containing for example, a suitable eukaryotic promoter, a secretion signal, enhancers, and various introns. The gene construct can be introduced into the host cells using transfection, transformation, or transduction techniques.

The chimeric protein of the invention can be produced by growing a host cell transfected with an expression vector encoding the chimeric protein under conditions that permit expression of the protein. Following expression, the protein can be harvested and purified using techniques well known in the art, e.g., affinity tags such as glutathione-S-transferase (GST) and histidine tags or by chromatography.

Accordingly, in various embodiments, the present invention provides for a nucleic acid encoding a chimeric protein of the present invention. In various embodiments, the present invention provides for a host cell comprising a nucleic acid encoding a chimeric protein of the present invention.

In various embodiments, the present chimeric protein may be expressed in vivo, for instance, in a patient. For example, in various embodiments, the present chimeric protein may be administered in the form of nucleic acid which encodes the present chimeric. In various embodiments, the nucleic acid is DNA or RNA. In some embodiments, present chimeric protein is encoded by a modified mRNA, i.e. an mRNA comprising one or more modified nucleotides. In some embodiments, the modified mRNA comprises one or modifications found in U.S. Pat. No. 8,278,036, the entire contents of which are hereby incorporated by reference. In some embodiments, the modified mRNA comprises one or more of m5C, m5U, m6A, s2U, ψ, and 2'-O-methyl-U. In some embodiments, the present invention relates to administering a modified mRNA encoding one or more of the present chimeric proteins. In some embodiments, the present invention relates to gene therapy vectors comprising the same. In some embodiments, the present invention relates to gene therapy methods comprising the same. In various embodiments, the nucleic acid is in the form of an oncolytic virus, e.g. an adenovirus, retrovirus, measles, herpes simplex, Newcastle disease virus or vaccinia.

Pharmaceutically Acceptable Salts and Excipients

The chimeric proteins described herein can possess a sufficiently basic functional group, which can react with an inorganic or organic acid, or a carboxyl group, which can react with an inorganic or organic base, to form a pharmaceutically acceptable salt. A pharmaceutically acceptable acid addition salt is formed from a pharmaceutically acceptable acid, as is well known in the art. Such salts include the pharmaceutically acceptable salts listed in, for example, *Journal of Pharmaceutical Science*, 66, 2-19 (1977) and *The Handbook of Pharmaceutical Salts; Properties, Selection, and Use.* P. H. Stahl and C. G. Wermuth (eds.), Verlag, Zurich (Switzerland) 2002, which are hereby incorporated by reference in their entirety.

Pharmaceutically acceptable salts include, by way of non-limiting example, sulfate, citrate, acetate, oxalate, chloride, bromide, iodide, nitrate, bisulfate, phosphate, acid phosphate, isonicotinate, lactate, salicylate, acid citrate, tartrate, oleate, tannate, pantothenate, bitartrate, ascorbate, succinate, maleate, gentisinate, fumarate, gluconate, glucaronate, saccharate, formate, benzoate, glutamate, methanesulfonate, ethanesulfonate, benzenesulfonate, p-toluenesulfonate, camphorsulfonate, pamoate, phenylacetate, trifluoroacetate, acrylate, chlorobenzoate, dinitrobenzoate, hydroxybenzoate, methoxybenzoate, methylbenzoate, o-acetoxybenzoate, naphthalene-2-benzoate, isobutyrate, phenylbutyrate, α-hydroxybutyrate, butyne-1,4-dicarboxylate, hexyne-1,4-dicarboxylate, caprate, caprylate, cinnamate, glycollate, heptanoate, hippurate, malate, hydroxymaleate, malonate, mandelate, mesylate, nicotinate, phthalate, teraphthalate, propiolate, propionate, phenylpropionate, sebacate, suberate, p-bromobenzenesulfonate, chlorobenzenesulfonate, ethylsulfonate, 2-hydroxyethylsulfonate, methylsulfonate, naphthalene-1-sulfonate, naphthalene-2-sulfonate, naphthalene-1,5-sulfonate, xylenesulfonate, and tartarate salts.

The term "pharmaceutically acceptable salt" also refers to a salt of the compositions of the present invention having an acidic functional group, such as a carboxylic acid functional group, and a base. Suitable bases include, but are not limited to, hydroxides of alkali metals such as sodium, potassium, and lithium; hydroxides of alkaline earth metal such as calcium and magnesium; hydroxides of other metals, such as aluminum and zinc; ammonia, and organic amines, such as unsubstituted or hydroxy-substituted mono-, di-, or tri-alkylamines, dicyclohexylamine; tributyl amine; pyridine; N-methyl, N-ethylamine; diethylamine; triethylamine; mono-, bis-, or tris-(2-OH-lower alkylamines), such as mono-; bis-, or tris-(2-hydroxyethyl)amine, 2-hydroxy-tert-butylamine, or tris-(hydroxymethyl)methylamine, N,N-di-lower alkyl-N-(hydroxyl-lower alkyl)-amines, such as N,N-dimethyl-N-(2-hydroxyethyl)amine or tri-(2-hydroxyethyl)amine; N-methyl-D-glucamine; and amino acids such as arginine, lysine, and the like.

In some embodiments, the compositions described herein are in the form of a pharmaceutically acceptable salt.

Pharmaceutical Compositions and Formulations

In various embodiments, the present invention pertains to pharmaceutical compositions comprising the chimeric proteins described herein and a pharmaceutically acceptable carrier or excipient. Any pharmaceutical compositions described herein can be administered to a subject as a component of a composition that comprises a pharmaceutically acceptable carrier or vehicle. Such compositions can optionally comprise a suitable amount of a pharmaceutically acceptable excipient so as to provide the form for proper administration.

In various embodiments, pharmaceutical excipients can be liquids, such as water and oils, including those of petroleum, animal, vegetable, or synthetic origin, such as peanut oil, soybean oil, mineral oil, sesame oil and the like. The pharmaceutical excipients can be, for example, saline, gum acacia, gelatin, starch paste, talc, keratin, colloidal silica, urea and the like. In addition, auxiliary, stabilizing, thickening, lubricating, and coloring agents can be used. In one embodiment, the pharmaceutically acceptable excipients are sterile when administered to a subject. Water is a useful excipient when any agent described herein is administered intravenously. Saline solutions and aqueous dextrose and glycerol solutions can also be employed as liquid excipients, specifically for injectable solutions.

Suitable pharmaceutical excipients also include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like. Any agent described herein, if desired, can also comprise minor amounts of wetting or emulsifying agents, or pH buffering agents. Other examples of suitable pharmaceutical excipients are described in *Remington's Pharmaceutical Sciences* 1447-1676 (Alfonso R. Gennaro eds., 19th ed. 1995), incorporated herein by reference.

The present invention includes the described pharmaceutical compositions (and/or additional therapeutic agents) in various formulations. Any inventive pharmaceutical composition (and/or additional therapeutic agents) described herein can take the form of solutions, suspensions, emulsion, drops, tablets, pills, pellets, capsules, capsules containing liquids, gelatin capsules, powders, sustained-release formulations, suppositories, emulsions, aerosols, sprays, suspensions, lyophilized powder, frozen suspension, desiccated powder, or any other form suitable for use. In one embodiment, the composition is in the form of a capsule. In another embodiment, the composition is in the form of a tablet. In yet another embodiment, the pharmaceutical composition is formulated in the form of a soft-gel capsule. In a further embodiment, the pharmaceutical composition is formulated in the form of a gelatin capsule. In yet another embodiment, the pharmaceutical composition is formulated as a liquid.

Where necessary, the inventive pharmaceutical compositions (and/or additional agents) can also include a solubilizing agent. Also, the agents can be delivered with a suitable vehicle or delivery device as known in the art. Combination therapies outlined herein can be co-delivered in a single delivery vehicle or delivery device.

The formulations comprising the inventive pharmaceutical compositions (and/or additional agents) of the present invention may conveniently be presented in unit dosage forms and may be prepared by any of the methods well known in the art of pharmacy. Such methods generally include the step of bringing the therapeutic agents into association with a carrier, which constitutes one or more accessory ingredients. Typically, the formulations are prepared by uniformly and intimately bringing the therapeutic agent into association with a liquid carrier, a finely divided solid carrier, or both, and then, if necessary, shaping the product into dosage forms of the desired formulation (e.g., wet or dry granulation, powder blends, etc., followed by tableting using conventional methods known in the art).

In various embodiments, any pharmaceutical compositions (and/or additional agents) described herein is formulated in accordance with routine procedures as a composition adapted for a mode of administration described herein.

Routes of administration include, for example: oral, intradermal, intramuscular, intraperitoneal, intravenous, subcutaneous, intranasal, epidural, sublingual, intranasal, intracerebral, intravaginal, transdermal, rectally, by inhalation, or topically. Administration can be local or systemic. In some embodiments, the administering is effected orally. In another embodiment, the administration is by parenteral injection. The mode of administration can be left to the discretion of the practitioner, and depends in-part upon the site of the medical condition. In most instances, administration results in the release of any agent described herein into the bloodstream.

In one embodiment, the chimeric protein described herein is formulated in accordance with routine procedures as a composition adapted for oral administration. Compositions for oral delivery can be in the form of tablets, lozenges, aqueous or oily suspensions, granules, powders, emulsions, capsules, syrups, or elixirs, for example. Orally administered compositions can comprise one or more agents, for example, sweetening agents such as fructose, aspartame or saccharin; flavoring agents such as peppermint, oil of wintergreen, or cherry; coloring agents; and preserving agents, to provide a pharmaceutically palatable preparation. Moreover, where in tablet or pill form, the compositions can be coated to delay disintegration and absorption in the gastrointestinal tract thereby providing a sustained action over an extended period of time. Selectively permeable membranes surrounding an osmotically active driving any chimeric proteins described herein are also suitable for orally administered compositions. In these latter platforms, fluid from the environment surrounding the capsule is imbibed by the driving compound, which swells to displace the agent or agent composition through an aperture. These delivery platforms can provide an essentially zero order delivery profile as opposed to the spiked profiles of immediate release formulations. A time-delay material such as glycerol monostearate or glycerol stearate can also be useful. Oral compositions can include standard excipients such as mannitol, lactose, starch, magnesium stearate, sodium saccharin, cellulose, and magnesium carbonate. In one embodiment, the excipients are of pharmaceutical grade. Suspensions, in addition to the active compounds, may contain suspending agents such as, for example, ethoxylated isostearyl alcohols, polyoxyethylene sorbitol and sorbitan esters, microcrystalline cellulose, aluminum metahydroxide, bentonite, agar-agar, tragacanth, etc., and mixtures thereof.

Dosage forms suitable for parenteral administration (e.g., intravenous, intramuscular, intraperitoneal, subcutaneous and intra-articular injection and infusion) include, for example, solutions, suspensions, dispersions, emulsions, and the like. They may also be manufactured in the form of sterile solid compositions (e.g., lyophilized composition), which can be dissolved or suspended in sterile injectable medium immediately before use. They may contain, for example, suspending or dispersing agents known in the art. Formulation components suitable for parenteral administration include a sterile diluent such as water for injection, saline solution, fixed oils, polyethylene glycols, glycerine, propylene glycol or other synthetic solvents; antibacterial agents such as benzyl alcohol or methyl paraben; antioxidants such as ascorbic acid or sodium bisulfite; chelating agents such as EDTA; buffers such as acetates, citrates or phosphates; and agents for the adjustment of tonicity such as sodium chloride or dextrose.

For intravenous administration, suitable carriers include physiological saline, bacteriostatic water, Cremophor EL™ (BASF, Parsippany, N.J.) or phosphate buffered saline (PBS). The carrier should be stable under the conditions of manufacture and storage, and should be preserved against microorganisms. The carrier can be a solvent or dispersion medium containing, for example, water, ethanol, polyol (for example, glycerol, propylene glycol, and liquid polyethylene glycol), and suitable mixtures thereof.

The compositions provided herein, alone or in combination with other suitable components, can be made into aerosol formulations (i.e., "nebulized") to be administered via inhalation. Aerosol formulations can be placed into pressurized acceptable propellants, such as dichlorodifluoromethane, propane, nitrogen, and the like.

Any inventive pharmaceutical compositions (and/or additional agents) described herein can be administered by controlled-release or sustained-release means or by delivery devices that are well known to those of ordinary skill in the art. Examples include, but are not limited to, those described in U.S. Pat. Nos. 3,845,770; 3,916,899; 3,536,809; 3,598,123; 4,008,719; 5,674,533; 5,059,595; 5,591,767; 5,120,548; 5,073,543; 5,639,476; 5,354,556; and 5,733,556, each of which is incorporated herein by reference in its entirety. Such dosage forms can be useful for providing controlled- or sustained-release of one or more active ingredients using, for example, hydropropyl cellulose, hydropropylmethyl cellulose, polyvinylpyrrolidone, other polymer matrices, gels, permeable membranes, osmotic systems, multilayer coatings, microparticles, liposomes, microspheres, or a combination thereof to provide the desired release profile in varying proportions. Suitable controlled- or sustained-release formulations known to those skilled in the art, including those described herein, can be readily selected for use with the active ingredients of the agents described herein. The invention thus provides single unit dosage forms suitable for oral administration such as, but not limited to, tablets, capsules, gelcaps, and caplets that are adapted for controlled- or sustained-release.

Controlled- or sustained-release of an active ingredient can be stimulated by various conditions, including but not limited to, changes in pH, changes in temperature, stimulation by an appropriate wavelength of light, concentration or availability of enzymes, concentration or availability of water, or other physiological conditions or compounds.

In another embodiment, a controlled-release system can be placed in proximity of the target area to be treated, thus requiring only a fraction of the systemic dose (see, e.g., Goodson, in *Medical Applications of Controlled Release*, supra, vol. 2, pp. 115-138 (1984)). Other controlled-release systems discussed in the review by Langer, 1990, Science 249:1527-1533) may be used.

Pharmaceutical formulations preferably are sterile. Sterilization can be accomplished, for example, by filtration through sterile filtration membranes. Where the composition is lyophilized, filter sterilization can be conducted prior to or following lyophilization and reconstitution.

Administration and Dosage

It will be appreciated that the actual dose of the chimeric protein to be administered according to the present invention will vary according to the particular dosage form, and the mode of administration. Many factors that may modify the action of the chimeric protein (e.g., body weight, gender, diet, time of administration, route of administration, rate of excretion, condition of the subject, drug combinations, genetic disposition and reaction sensitivities) can be taken into account by those skilled in the art. Administration can be carried out continuously or in one or more discrete doses within the maximum tolerated dose. Optimal administration rates for a given set of conditions can be ascertained by those skilled in the art using conventional dosage administration tests.

In some embodiments, a suitable dosage of the chimeric protein is in a range of about 0.01 mg/kg to about 10 g/kg of body weight of the subject, about 0.01 mg/kg to about 1 g/kg of body weight of the subject, about 0.01 mg/kg to about 100 mg/kg of body weight of the subject, about 0.01 mg/kg to about 10 mg/kg of body weight of the subject, for example, about 0.01 mg/kg, about 0.02 mg/kg, about 0.03 mg/kg, about 0.04 mg/kg, about 0.05 mg/kg, about 0.06 mg/kg, about 0.07 mg/kg, about 0.08 mg/kg, about 0.09 mg/kg, about 0.1 mg/kg, about 0.2 mg/kg, about 0.3 mg/kg, about 0.4 mg/kg, about 0.5 mg/kg, about 0.6 mg/kg, about 0.7 mg/kg, about 0.8 mg/kg, about 0.9 mg/kg, about 1 mg/kg, about 1.1 mg/kg, about 1.2 mg/kg, about 1.3 mg/kg, about 1.4 mg/kg, about 1.5 mg/kg, about 1.6 mg/kg, about 1.7 mg/kg, about 1.8 mg/kg, 1.9 mg/kg, about 2 mg/kg, about 3 mg/kg, about 4 mg/kg, about 5 mg/kg, about 6 mg/kg, about 7 mg/kg, about 8 mg/kg, about 9 mg/kg, about 10 mg/kg body weight, about 100 mg/kg body weight, about 1 g/kg of body weight, about 10 g/kg of body weight, inclusive of all values and ranges therebetween.

Individual doses of the chimeric protein can be administered in unit dosage forms (e.g., tablets or capsules) containing, for example, from about 0.01 mg to about 100 g, from about 0.01 mg to about 75 g, from about 0.01 mg to about 50 g, from about 0.01 mg to about 25 g, about 0.01 mg to about 10 g, about 0.01 mg to about 7.5 g, about 0.01 mg to about 5 g, about 0.01 mg to about 2.5 g, about 0.01 mg to about 1 g, about 0.01 mg to about 100 mg, from about 0.1 mg to about 100 mg, from about 0.1 mg to about 90 mg, from about 0.1 mg to about 80 mg, from about 0.1 mg to about 70 mg, from about 0.1 mg to about 60 mg, from about 0.1 mg to about 50 mg, from about 0.1 mg to about 40 mg active ingredient, from about 0.1 mg to about 30 mg, from about 0.1 mg to about 20 mg, from about 0.1 mg to about 10 mg, from about 0.1 mg to about 5 mg, from about 0.1 mg to about 3 mg, from about 0.1 mg to about 1 mg per unit dosage form, or from about 5 mg to about 80 mg per unit dosage form. For example, a unit dosage form can be about 0.01 mg, about 0.02 mg, about 0.03 mg, about 0.04 mg, about 0.05 mg, about 0.06 mg, about 0.07 mg, about 0.08 mg, about 0.09 mg, about 0.1 mg, about 0.2 mg, about 0.3 mg, about 0.4 mg, about 0.5 mg, about 0.6 mg, about 0.7 mg, about 0.8 mg, about 0.9 mg, about 1 mg, about 2 mg, about 3 mg, about 4 mg, about 5 mg, about 6 mg, about 7 mg, about 8 mg, about 9 mg about 10 mg, about 15 mg, about 20 mg, about 25 mg, about 30 mg, about 35 mg, about 40 mg, about 45 mg, about 50 mg, about 55 mg, about 60 mg, about 65 mg, about 70 mg, about 75 mg, about 80 mg, about 85 mg, about 90 mg, about 95 mg, about 100 mg, about 200 mg, about 500 mg, about 1 g, about 2.5 g, about 5 g, about 10 g, about 25 g, about 50 g, about 75 g, about 100 g, inclusive of all values and ranges therebetween.

In one embodiment, the chimeric protein is administered at an amount of from about 0.01 mg to about 100 g daily, from about 0.01 mg to about 75 g daily, from about 0.01 mg to about 50 g daily, from about 0.01 mg to about 25 g daily, from about 0.01 mg to about 10 g daily, from about 0.01 mg to about 7.5 g daily, from about 0.01 mg to about 5 g daily, from about 0.01 mg to about 2.5 g daily, from about 0.01 mg to about 1 g daily, from about 0.01 mg to about 100 mg daily, from about 0.1 mg to about 100 mg daily, from about 0.1 mg to about 95 mg daily, from about 0.1 mg to about 90 mg daily, from about 0.1 mg to about 85 mg daily, from about 0.1 mg to about 80 mg daily, from about 0.1 mg to about 75 mg daily, from about 0.1 mg to about 70 mg daily, from about 0.1 mg to about 65 mg daily, from about 0.1 mg to about 60 mg daily, from about 0.1 mg to about 55 mg daily, from about 0.1 mg to about 50 mg daily, from about 0.1 mg to about 45 mg daily, from about 0.1 mg to about 40 mg daily, from about 0.1 mg to about 35 mg daily, from about 0.1 mg to about 30 mg daily, from about 0.1 mg to about 25 mg daily, from about 0.1 mg to about 20 mg daily, from about 0.1 mg to about 15 mg daily, from about 0.1 mg to about 10 mg daily, from about 0.1 mg to about 5 mg daily, from about 0.1 mg to about 3 mg daily, from about 0.1 mg to about 1 mg daily, or from about 5 mg to about 80 mg daily. In various embodiments, the chimeric protein is administered at a daily dose of about 0.01 mg, about 0.02 mg, about 0.03 mg, about 0.04 mg, about 0.05 mg, about 0.06 mg, about 0.07 mg, about 0.08 mg, about 0.09 mg, about 0.1 mg, about 0.2 mg, about 0.3 mg, about 0.4 mg, about 0.5 mg, about 0.6 mg, about 0.7 mg, about 0.8 mg, about 0.9 mg, about 1 mg, about 2 mg, about 3 mg, about 4 mg, about 5 mg, about 6 mg, about 7 mg, about 8 mg, about 9 mg about 10 mg, about 15 mg, about 20 mg, about 25 mg, about 30 mg, about 35 mg, about 40 mg, about 45 mg, about 50 mg, about 55 mg, about 60 mg, about 65 mg, about 70 mg, about 75 mg, about 80 mg, about 85 mg, about 90 mg, about 95 mg, about 100 mg, about 200 mg, about 500 mg, about 1 g, about 2.5 g, about 5 g, about 7.5 g, about 10 g, about 25 g, about 50 g, about 75 g, about 100 g, inclusive of all values and ranges therebetween.

In accordance with certain embodiments of the invention, the pharmaceutical composition comprising the chimeric protein may be administered, for example, more than once daily (e.g., about two times, about three times, about four times, about five times, about six times, about seven times, about eight times, about nine times, or about ten times daily), about once per day, about every other day, about every third day, about once a week, about once every two weeks, about once every month, about once every two months, about once every three months, about once every six months, or about once every year.

Combination Therapy and Additional Therapeutic Agents

In various embodiments, the pharmaceutical composition of the present invention is co-administered in conjunction with additional therapeutic agent(s). Co-administration can be simultaneous or sequential.

In one embodiment, the additional therapeutic agent and the chimeric protein of the present invention are administered to a subject simultaneously. The term "simultaneously" as used herein, means that the additional therapeutic agent and the chimeric protein are administered with a time separation of no more than about 60 minutes, such as no more than about 30 minutes, no more than about 20 minutes, no more than about 10 minutes, no more than about 5 minutes, or no more than about 1 minute. Administration of the additional therapeutic agent and the chimeric protein can be by simultaneous administration of a single formulation (e.g., a formulation comprising the additional therapeutic agent and the chimeric protein) or of separate formulations (e.g., a first formulation including the additional therapeutic agent and a second formulation including the chimeric protein).

Co-administration does not require the therapeutic agents to be administered simultaneously, if the timing of their administration is such that the pharmacological activities of the additional therapeutic agent and the chimeric protein overlap in time, thereby exerting a combined therapeutic effect. For example, the additional therapeutic agent and the chimeric protein can be administered sequentially. The term "sequentially" as used herein means that the additional therapeutic agent and the chimeric protein are administered with a time separation of more than about 60 minutes. For example, the time between the sequential administration of the additional therapeutic agent and the chimeric protein can be more than about 60 minutes, more than about 2 hours, more than about 5 hours, more than about 10 hours, more than about 1 day, more than about 2 days, more than about 3 days, more than about 1 week apart, more than about 2 weeks apart, or more than about one month apart. The optimal administration times will depend on the rates of metabolism, excretion, and/or the pharmacodynamic activity of the additional therapeutic agent and the chimeric protein being administered. Either the additional therapeutic agent or the chimeric protein cell may be administered first.

Co-administration also does not require the therapeutic agents to be administered to the subject by the same route of administration. Rather, each therapeutic agent can be administered by any appropriate route, for example, parenterally or non-parenterally.

In some embodiments, the chimeric protein described herein acts synergistically when co-administered with another therapeutic agent. In such embodiments, the chimeric protein and the additional therapeutic agent may be administered at doses that are lower than the doses employed when the agents are used in the context of monotherapy.

In some embodiments, the present invention pertains to chemotherapeutic agents as additional therapeutic agents. For example, without limitation, such combination of the present chimeric proteins and chemotherapeutic agent find use in the treatment of cancers, as described elsewhere herein. Examples of chemotherapeutic agents include, but are not limited to, alkylating agents such as thiotepa and CYTOXAN cyclosphosphamide; alkyl sulfonates such as busulfan, improsulfan and piposulfan; aziridines such as benzodopa, carboquone, meturedopa, and uredopa; ethylenimines and methylamelamines including altretamine, triethylenemelamine, trietylenephosphoramide, triethiylenethiophosphoramide and trimethylolomelamine; acetogenins (e.g., bullatacin and bullatacinone); a camptothecin (including the synthetic analogue topotecan); bryostatin; cally statin; CC-1065 (including its adozelesin, carzelesin and bizelesin synthetic analogues); cryptophycins (e.g., cryptophycin 1 and cryptophycin 8); dolastatin; duocarmycin (including the synthetic analogues, KW-2189 and CB 1-TM1); eleutherobin; pancratistatin; a sarcodictyin; spongistatin; nitrogen mustards such as chlorambucil, chlornaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosureas such as carmustine, chlorozotocin, fotemustine, lomustine, nimustine, and ranimnustine; antibiotics such as the enediyne antibiotics (e.g., calicheamicin, especially calicheamicin gammaII and calicheamicin omegaII (see, e.g., Agnew, Chem. Intl. Ed. Engl., 33: 183-186 (1994)); dynemicin, including dynemicin A; bisphosphonates, such as clodronate; an esperamicin; as well as neocarzinostatin chromophore and related chromoprotein enediyne antibiotic chromophores), aclacinomysins, actinomycin, authramycin, azaserine, bleomycins, cactinomycin, carabicin, caminomycin, carzinophilin, chromomycinis, dactinomycin, daunorubicin, detorubicin, 6-diazo-5-oxo-L-norleucine, ADRIAMYCIN doxorubicin (including morpholino-doxorubicin, cyanomorpholino-doxorubicin, 2-pyrrolino-doxorubicin and deoxy doxorubicin), epirubicin, esorubicin, idarubicin, marcellomycin, mitomycins such as mitomycin C, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine; androgens such as calusterone, dromostanolone propionate, epitiostanol, mepitiostane, testolactone; anti-adrenals such as minoglutethimide, mitotane, trilostane; folic acid replenisher such as frolinic acid; aceglatone; aldophosphamide glycoside; aminolevulinic acid; eniluracil; amsacrine; bestrabucil; bisantrene; edatraxate; demecolcine; diaziquone; elformithine; elliptinium acetate; an epothilone; etoglucid; gallium nitrate; hydroxyurea; lentinan; lonidainine; maytansinoids such as maytansine and ansamitocins; mitoguazone; mitoxantrone; mopidanmol; nitraerine; pentostatin; phenamet; pirarubicin; losoxantrone; podophyllinic acid; 2-ethylhydrazide; procarbazine; PSK polysaccharide complex (JHS Natural Products, Eugene, Oreg.); razoxane; rhizoxin; sizofuran; spirogermanium; tenuazonic acid; triaziquone; 2,2',2"-trichlorotriethylamine; trichothecenes (e.g., T-2 toxin, verracurin A, roridin A and anguidine); urethan; vindesine; dacarbazine; mannomustine; mitobronitol; mitolactol; pipobroman; gacytosine; arabinoside ("Ara-C"); cyclophosphamide; thiotepa; taxoids, e.g., TAXOL paclitaxel (Bristol-Myers Squibb Oncology, Princeton, N.J.), ABRAXANE Cremophor-free, albumin-engineered nanoparticle formulation of paclitaxel (American Pharmaceutical Partners, Schaumberg, 111), and TAXOTERE doxetaxel (Rhone-Poulenc Rorer, Antony, France); chloranbucil; GEMZAR gemcitabine; 6-thioguanine; mercaptopurine; methotrexate; platinum analogs such as cisplatin, oxaliplatin and carboplatin; vinblastine; platinum; etoposide (VP-16); ifosfamide; mitoxantrone; vincristine; NAVELBINE. vinorelbine; novantrone; teniposide; edatrexate; daunomycin; aminopterin; xeloda; ibandronate; irinotecan (Camptosar, CPT-11) (including the treatment regimen of irinotecan with 5-FU and leucovorin); topoisomerase inhibitor RFS 2000; difluoromethylornithine (DMFO); retinoids such as retinoic acid, all-trans retinoic acid (ATRA), capecitabine; combretastatin; leucovorin (LV); oxaliplatin, including the oxaliplatin treatment regimen (FOLFOX); lapatinib (Tykerb); inhibitors of PKC-α, Raf, H-Ras, EGFR (e.g., erlotinib (Tarceva)) and VEGF-A that reduce cell proliferation and pharmaceutically acceptable salts, acids or derivatives of any of the above. In addition, the methods of treatment can further include the use of radiation. In addition, the methods of treatment can further include the use of photodynamic therapy.

In some embodiments, inclusive of, without limitation, infectious disease applications, the present invention pertains to anti-infectives as additional therapeutic agents. In some embodiments, the anti-infective is an anti-viral agent including, but not limited to, Abacavir, Acyclovir, Adefovir, Amprenavir, Atazanavir, Cidofovir, Darunavir, Delavirdine, Didanosine, Docosanol, Efavirenz, Elvitegravir, Emtricitabine, Enfuvirtide, Etravirine, Famciclovir, and Foscarnet. In some embodiments, the anti-infective is an anti-bacterial agent including, but not limited to, cephalosporin antibiotics (cephalexin, cefuroxime, cefadroxil, cefazolin, cephalothin, cefaclor, cefamandole, cefoxitin, cefprozil, and ceftobiprole); fluoroquinolone antibiotics (cipro, Levaquin, floxin, tequin, avelox, and norflox); tetracycline antibiotics (tetracycline, minocycline, oxytetracycline, and doxycycline); penicillin antibiotics (amoxicillin, ampicillin, penicillin V, dicloxacillin, carbenicillin, vancomycin, and methicillin); monobactam antibiotics (aztreonam); and carbapenem antibiotics (ertapenem, doripenem, imipenem/cilastatin, and meropenem). In some embodiments, the anti-infectives include anti-malarial agents (e.g., chloroquine, quinine, mefloquine, primaquine, doxycycline, artemether/lumefantrine, atovaquone/proguanil and sulfadoxine/pyrimethamine), metronidazole, tinidazole, ivermectin, pyrantel pamoate, and albendazole.

In some embodiments, inclusive, without limitation, of autoimmmune applications, the additional therapeutic agent is an immunosuppressive agent. In some embodiments, the immunosuppressive agent is an anti-inflammatory agent such as a steroidal anti-inflammatory agent or a non-steroidal anti-inflammatory agent (NSAID). Steroids, particularly the adrenal corticosteroids and their synthetic analogues, are well known in the art. Examples of corticosteroids useful in the present invention include, without limitation, hydroxyltriamcinolone, alpha-methyl dexamethasone, beta-methyl betamethasone, beclomethasone dipropionate, betamethasone benzoate, betamethasone dipropionate, betamethasone valerate, clobetasol valerate, desonide, desoxymethasone, dexamethasone, diflorasone diacetate, diflucortolone valerate, fluadrenolone, fluclorolone acetonide, flumethasone pivalate, fluosinolone acetonide, fluocinonide, flucortine butylester, fluocortolone, fluprednidene (fluprednylidene) acetate, flurandrenolone, halcinonide, hydrocortisone acetate, hydrocortisone butyrate, methylprednisolone, triamcinolone acetonide, cortisone, cortodoxone, flucetonide, fludrocortisone, difluorosone diacetate, fluradrenolone acetonide, medrysone, amcinafel, amcinafide, betamethasone and the balance of its esters, chloroprednisone, clocortelone, clescinolone, dichlorisone, difluprednate, flucloronide, flunisolide, fluoromethalone, fluperolone, fluprednisolone, hydrocortisone, meprednisone, paramethasone, prednisolone, prednisone, beclomethasone dipropionate. (NSAIDS) that may be used in the present invention, include but are not limited to, salicylic acid, acetyl salicylic acid, methyl salicylate, glycol salicylate, salicylmides, benzyl-2,5-diacetoxybenzoic acid, ibuprofen, fulindac, naproxen, ketoprofen, etofenamate, phenylbutazone, and indomethacin. In some embodiments, the immunosupressive agent may be cytostatics such as alkylating agents, antimetabolites (e.g., azathioprine, methotrexate), cytotoxic antibiotics, antibodies (e.g., basiliximab, daclizumab, and muromonab), anti-immunophilins (e.g., cyclosporine, tacrolimus, sirolimus), inteferons, opioids, TNF binding proteins, mycophenolates, and small biological agents (e.g., fingolimod, myriocin). Additional anti-inflammatory agents are described, for example, in U.S. Pat. No. 4,537,776, the entire contents of which is incorporated by reference herein.

In some embodiments, the present invention pertains to various agents used for treating obesity as additional therapeutic agents. Illustrative agents used for treating obesity include, but are not limited to, orlistat (e.g., ALL1, XENICAL), loracaserin (e.g., BELVIQ), phentermine-topiramate (e.g., QSYMIA), sibutramme (e.g., REDUCTIL or MERJDIA), rimonabant (ACOMPLLA), exenatide (e.g., BYETTA), pramlintide (e.g., SYMLIN) phentermine, benzphetamine, diethylpropion, phendimetrazme, bupropion, and metformin. Agents that interfere with the body's ability to absorb specific nutrients in food are among the additional agents, e.g., orlistat (e.g., ALU, XENICAL), glucomannan, and guar gum. Agents that suppress apetite are also among the additional agents, e.g., catecholamines and their derivatives (such as phenteimine and other amphetamine-based drugs), various antidepressants and mood stabilizers (e.g., bupropion and topiramate), anorectics (e.g., dexedrine, digoxin). Agents that increase the body's metabolism are also among the additional agents.

In some embodiments, additional therapeutic agents may be selected from among appetite suppressants, neurotransmitter reuptake inhibitors, dopaminergic agonists, serotonergic agonists, modulators of GABAergic signaling, anticonvulsants, antidepressants, monoamine oxidase inhibitors, substance P (NK1) receptor antagonists, melanocortin receptor agonists and antagonists, lipase inhibitors, inhibitors of fat absorption, regulators of energy intake or metabolism, cannabinoid receptor modulators, agents for treating addiction, agents for treating metabolic syndrome, peroxisome proliferator-activated receptor (PPAR) modulators; dipeptidyl peptidase 4 (DPP-4) antagonists, agents for treating cardiovascular disease, agents for treating elevated triglyceride levels, agents for treating low HDL, agents for treating hypercholesterolemia, and agents for treating hypertension. Some agents for cardiovascular disease include statins (e.g., lovastatin, atorvastatin, fluvastatin, rosuvastatin, simvastatin and pravastatin) and omega-3 agents (e.g., LOVAZA, EPANQVA, VASCEPA, esterified omega-3's in general, fish oils, krill oils, algal oils). In some embodiments, additional agents may be selected from among amphetamines, benzodiazepines, suifonyl ureas, meglitinides, thiazolidinediones, biguanides, beta-blockers, XCE inhibitors, diuretics, nitrates, calcium channel blockers, phenlermine, sibutramine, iorcaserin, cetilistat, rimonabant, taranabant, topiramate, gabapentin, valproate, vigabatrin, bupropion, tiagabine, sertraline, fluoxetine, trazodone, zonisamide, methylphenidate, varenicline, naltrexone, diethylpropion, phendimetrazine, repaglinide, nateglinide, glimepiride, metformin, pioglitazone, rosiglilazone, and sitagliptin.

In some embodiments, the present invention pertains to an agent used for treating diabetes as additional therapeutic agents. Illustrative anti-diabetic agents include, but are not limited to, sulfonylurea (e.g., DYMELOR (acetohexamide), DIABINESE (chlorpropamide), ORINASE (tolbutamide), and TOLINASE (tolazamide), GLUCOTROL (glipizide), GLUCOTROL XL (extended release), DIABETA (glyburide), MICRONASE (glyburide), GLYNASE PRESTAB (glyburide), and AMARYL (glimepiride)); a Biguanide (e.g., metformin (GLUCOPHAGE, GLUCOPHAGE XR, RIOMET, FORTAMET, and GLUMETZA)); a thiazolidinediones (e.g., ACTOS (pioglitazone) and AVANDIA (rosiglitazone); an alpha-glucosidase inhibitor (e.g., PRECOSE (acarbose) and GLYSET (miglitol); a Meglitinide (e.g., PRANDIN (repaglinide) and STARLIX (nateglinide)); a Dipeptidyl peptidase IV (DPP-IV) inhibitor (e.g., JANUVIA (sitagliptin), NESINA (alogliptin), ONGLYZA (saxagliptin), and TRADJENTA (linagliptin)); Sodium-glucose co-transporter 2 (SGLT2) inhibitor (e.g., INVOKANA (canaglifozin)); and a combination pill (e.g., GLUCOVANCE, which combines glyburide (a sulfonylurea) and metformin, METAGLIP, which combines glipizide (a sulfonylurea) and metformin, and AVANDAMET, which uses both metformin and rosiglitazone (AVANDIA) in one pill, KAZANO (alogliptin and metformin), OSENI (alogliptin plus pioglitazone), METFORMIN oral, ACTOS oral, BYETTA subcutaneous, JANUVIA oral, WELCHOL oral, JANUMET oral, glipizide oral, glimepiride oral, GLUCOPHAGE oral, LANTUS subcutaneous, glyburide oral, ONGLYZA oral, AMARYI oral, LANTUS SOLOSTAR subcutaneous, BYDUREON subcutaneous, LEVEMIR FLEXPEN subcutaneous, ACTOPLUS MET oral, GLUMETZA oral, TRADJENTA oral, bromocriptine oral, KOMBIGLYZE XR oral, INVOKANA oral, PRANDIN oral, LEVEMIR subcutaneous, PARLODEL oral, pioglitazone oral, NOVOLOG subcutaneous, NOVOLOG FLEXPEN subcutaneous, VICTOZA 2-PAK subcutaneous, HUMALOG subcutaneous, STARLIX oral, FORTAMET oral, GLUCOVANCE oral, GLUCOPHAGE XR oral, NOVOLOG Mix 70-30 FLEXPEN subcutaneous, GLYBURIDE-METFORMIN oral, acarbose oral, SYMLINPEN 60 subcutaneous, GLUCOTROI XL oral, NOVOLIN R inj, GLUCOTROL oral, DUETACT oral, sitagliptin oral, SYMLINPEN 120 subcutaneous, HUMALOG KWIKPEN subcutaneous, JANUMET XR oral, GLIPIZIDE-METFORMIN oral, CYCLOSET oral, HUMALOG MIX 75-25 subcutaneous, nateglinide oral, HUMALOG Mix 75-25 KWIKPEN subcutaneous, HUMULIN 70/30 subcutaneous, PRECOSE oral, APIDRA subcutaneous, Humulin R inj, Jentadueto oral, Victoza 3-Pak subcutaneous, Novolin 70/30 subcutaneous, NOVOLIN N subcutaneous, insulin detemir subcutaneous, glyburide micronized oral, GLYNASE oral, HUMULIN N subcutaneous, insulin glargine subcutaneous, RIOMET oral, pioglitazone-metformin oral, APIDRA SOLOSTAR subcutaneous, insulin lispro subcutaneous, GLYSET oral, HUMULIN 70/30 Pen subcutaneous, colesevelam oral, sitagliptin-metformin oral, DIABETA oral, insulin regular human inj, HUMULIN N Pen subcutaneous, exenatide subcutaneous, HUMALOG Mix 50-50 KWIKPEN subcutaneous, liraglutide subcutaneous, KAZANO oral, repaglinide oral, chlorpropamide oral, insulin aspart subcutaneous, NOVOLOG Mix 70-30 subcutaneous, HUMALOG Mix 50-50 subcutaneous, saxagliptin oral, ACTOPLUS Met XR oral, miglitol oral, NPH insulin human recomb subcutaneous, insulin NPH and regular human subcutaneous, tolazamide oral, mifepristone oral, insulin aspart protam-insulin aspart subcutaneous, repaglinide-metformin oral, saxagliptin-metformin oral, linagliptin-metformin oral, NESINA oral, OSENI oral, tolbutamide oral, insulin lispro protamine and lispro subcutaneous, pramlintide subcutaneous, insulin glulisine subcutaneous, pioglitazone-glimepiride oral, PRANDI MET oral, NOVOLOG PenFill subcutaneous, linagliptin oral, exenatide microspheres subcutaneous, KORLYM oral, alogliptin oral, alogliptin-pioglitazone oral, alogliptin-metformin oral, canagliflozin oral, Lispro (HUMALOG); Aspart (NOVOLOG); Glulisine (APIDRA); Regular (NOVOLIN R or HUMULIN R); NPH (NOVOLIN N or HUMULIN N); Glargine (LANTUS); Detemir (LEVEMIR); HUMULIN or NOVOLIN 70/30; and NOVOLOG Mix 70/30 HUMALOG Mix 75/25 or 50/50.

In some embodiments, the present invention pertains to an agent used for treating MS as additional therapeutic agents. Illustrative MS agents include, but are not limited to various disease modifying therapies:

| Generic Name | Branded Name/Company | Frequency/Route of Delivery/Usual Dose |
|---|---|---|
| teriflunomide | AUBAGIO (GENZYME) | Every day; pill taken orally; 7 mg or 14 mg. |
| interferon beta-1a | AVONEX (BIOGEN IDEC) | Once a week; intramuscular (into the muscle) injection; 30 mcg |
| interferon beta-1b | BETASERON (BAYER HEALTHCARE PHARMACEUTICALS, INC.) | Every other day; subcutaneous (under the skin) injection; 250 mcg. |
| glatiramer acetate | COPAXONE (TEVA NEUROSCIENCE) | Every day; subcutaneous (under the skin) injection; 20 mg (20,000 mcg) OR Three times a week; subcutaneous (under the skin) injection; 40 mg (40,000 mcg) |
| interferon beta-1b | EXTAVIA (NOVARTIS PHARMACEUTICALS CORP.) | Every other day; subcutaneous (under the skin) injection; 250 mcg. |
| fingolimod | GILENYA (NOVARTIS PHARMACEUTICALS CORP.) | Every day; capsule taken orally; 0.5 mg. |
| Alemtuzumab (anti-CD52 monoclonal antibody) | LEMTRADA (GENZYME) | Intravenous infusion on five consecutive days, followed by intravenous infusion on three consecutive days one year later (12 mg) |

-continued

| Generic Name | Branded Name/Company | Frequency/Route of Delivery/Usual Dose |
|---|---|---|
| mitoxantrone | NOVANTRONE (EMD SERONO) | Four times a year by IV infusion in a medical facility. Lifetime cumulative dose limit of approximately 8-12 doses over 2-3 years (140 mg/m2). |
| pegylated interferon beta-1a | PLEGRIDY (BIOGEN IDEC) | Every 14 days; subcutaneous (under the skin) injection; 125 mcg |
| interferon beta-1a | REBIF (EMD SERONO, INC.) | Three times a week; subcutaneous (under the skin) injection; 44 mcg |
| dimethyl fumarate (BG-12) | TECFIDERA (BIOGEN IDEC) | Twice a day; capsule taken orally; 120 mg for one week and 240 mg therafter |
| Natalizumab (humanized monoclonal antibody VLA-4 antagonist) | TYSABRI (BIOGEN IDEC) | Every four weeks by IV infusion in a registered infusion facility; 300 mg |
| DMTs in Development | | |
| Amiloride (targets Acid-sensing ion channel-1 Epithelial sodium channel Na+/H+ exchanger) | PAR PHARMACEUTICAL, PERRIGO COMPANY, SIGMAPHARM LABORATORIES | Oral |
| ATX-MS-1467 (targets Major histocompatibility complex class II T cell responses to myelin basic protein) | APITOPE/MERCK SERONO | Intradermal Subcutaneous |
| BAF312 (targets Sphingosine 1-phosphate (S1P) receptor subtypes S1P1 and S1P5 B cell distrubution T cell distribution) | NOVARTIS PHARMA | Oral |
| BGC20-0134 (targets Proinflammatory and anti-inflammatory cytokines) | BTG PLC | Oral |
| BIIB033 (targets LINGO-1 ("leucine-rich repeat and immunoglobulin-like domain-containing, Nogo receptor-interacting protein")) | BIOGEN | Intravenous infusion used in Phase I and Phase II trials Subcutaneous injection used in Phase I trial |
| Cladribine (targets CD4+ T cells DNA synthesis and repair E-selectin Intracellular adhesion molecule-1 Pro-inflammatory cytokines interleukin 2 and interleukin 2R Pro-inflammatory cytokines interleukin 8 and RANTES Cytokine secretion Monocyte and lymphocyte migration) | MERCK SERONO | Oral |
| Cyclophosphamide (targets T cells, particularly CD4+ helper T cells B cells) | BAXTER HEALTHCARE CORPORATION | Oral, monthly intravenous pulses |
| Daclizumab (humanized monoclonal antibody targeting CD25 Immune modulator of T cells) | BIOGEN IDEC/ABBVIE BIOTHERAPEUTICS | Projected to be IM injection once monthly |
| Dalfampridine (targets Voltage-gated potassium channels Degenerin/epithelial sodium channels L-type calcium channels that contain subunit Cavbeta3) | ACORDA THERAPEUTICS/ BIOGEN IDEC | One tablet every 12 hours (extended release), 10 mg twice a day |
| Dronabinol (targets Cannabinoid receptor CB1 Cannabinoid receptor CB2) | ABBVIE INC. | Oral |
| Firategrast (targets Alpha4beta1 integrin) | GLAXOSMITHKLINE | Oral |
| GNbAC1MSRV-Env (targets envelope protein of the MS-associated retrovirus) | GENEURO SA/SERVIER | Intravenous infusion |
| Idebenone (targets Reactive oxygen species) | SANTHERA PHARMACEUTICALS | Oral Dose in clinical trial for PPMS is 2250 mg per day (750 mg dose, 3 times per day) |
| Imilecleucel-T (targets Myelin-specific, autoreactive T cells) | OPEXA THERAPEUTICS/ MERCK SERONO | Subcutaneous Given 5 times per year, according to information from the manufacturer |
| Laquinimod | TEVA | Projected to be 0.6 mg or 1.2 mg oral tablet taken daily |

| Generic Name | Branded Name/Company | Frequency/Route of Delivery/Usual Dose |
|---|---|---|
| Masitinib (targets KIT (a stem cell factor, also called c-KIT) receptor as well as select other tyrosine kinases Mast cells) | AB SCIENCE | Oral |
| MEDI-551 (targets CD19, a B cell-specific antigen that is part of the B cell receptor complex and that functions in determining the threshold for B cell activation B cells Plasmablasts, B cells that express CD19 (but not CD20) and that secrete large quantities of antibodies; depletion of plasmablasts may be useful in autoimmune diseases involving pathogenic autoantibodies) | MEDIMMUNE | Intravenous Subcutaneous |
| Minocycline (targets T cells Microglia Leukocyte migration Matrix metalloproteinases) | VARIOUS | Oral Available as pellet-filled capsules and an oral suspension |
| MIS416 (targets Innate immune system Pathogen-associated molecular pattern recognition receptors of the innate immune system Myeloid cells of the innate immune system, which might be able to remodel the deregulated immune system activity that occurs in SPMS) | INNATE IMMUNOTHERAPEUTICS | Intravenous |
| Mycophenolate mofetil (targets Purine synthesis) | MANUFACTURED BY GENENTECH | Oral |
| Naltrexone (targets Opioid receptors Toll-like receptor 4) | VARIOUS | Given at low doses (3 to 4.5 mg per day) in oral form as "Low-dose naltrexone" (or "LDN") |
| Ocrelizumab and Ofatumumab (humanized monoclonal antibodies targeting CD20 B cell suppression | ROCHE/GSK | Projected to be IV infusion |
| ONO-4641 (targets Sphingosine 1-phosphate receptor) | ONO PHARMACEUTICAL CO. | Oral |
| Phenytoin (targets Sodium channels) | PFIZER | Intravenous Intramuscular (less favored option) Oral |
| Ponesimod | ACTELION | To be determined |
| Raltegravir (targets Retroviral integrase Herpesvirus DNA packaging terminase) | MERCK | Oral 400 mg tablet twice daily, according to information from the manufacturer |
| RHB-104 | REDHILL BIOPHARMA LIMITED | 95 mg clarithromycin, 45 mg rifabutin, and 10 mg clofazimine |
| Riluzole (targets Glutamatergic neurotransmission Glutamate uptake and release Voltage-gated sodium channels Protein kinase C) | COVIS PHARMA/SANOFI | Oral |

In some embodiments, the present invention relates to combination therapy with a blood transfusion. For instance, the present compositions may supplement a blood transfusion. In some embodiments, the present invention relates to combination therapy with iron supplements.

In some embodiments, the present invention relates to combination therapy with one or more EPO-based agents. For example, the present compositions may be used as an adjuvant to other EPO-based agents. In some embodiments, the present compositions are used as a maintenance therapy to other EPO-based agents. Other EPO-based agents include the following: epoetin alfa, including without limitation, DARBEPOETIN (ARANESP), EPOCEPT (LUPIN PHARMA), NANOKINE (NANOGEN PHARMACEUTICAL), EPOFIT (INTAS PHARMA), EPOGEN (AMGEN), EPOGIN, EPREX, (JANSSEN-CILAG), BINOCRIT7 (SANDOZ), PROCRIT; epoetin beta, including without limitation, NEORECORMON (HOFFMANN-LA ROCHE), RECORMON, Methoxy polyethylene glycol-epoetin beta (MIRCERA, ROCHE); epoetin delta, including without limitation, DYNEPO (erythropoiesis stimulating protein, SHIRE PLC); epoetin omega, including without limitation, EPOMAX; epoetin zeta, including without limitation, SILAPO (STADA) and RETACRIT (HOSPIRA) and other EPOs, including without limitation, EPOCEPT (LUPIN PHARMACEUTICALS), EPOTRUST (PANACEA BIOTEC LTD), ERYPRO SAFE (BIOCON LTD.), REPOITIN (SERUM INSTITUTE OF INDIA LIMITED), VINTOR (EMCURE PHARMACEUTICALS), EPOFIT (INTAS PHARMA), ERYKINE (INTAS BIOPHARMACEUTICA), WEPDX (WOCKHARDT BIOTECH), ESPOGEN (LG LIFE SCIENCES), RELIPOIETIN (RELIANCE LIFE SCIENCES), SHANPOIETIN (SHANTHA BIOTECHNICS LTD), ZYROP (CADILA HEALTHCARE LTD.), EPIAO (RHUEPO) (SHENYANG SUNSHINE PHARMACEUTICAL CO. LTD), CINNAPOIETIN (CINNAGEN).

In some embodiments, the present invention relates to combination therapy with one or more immune-modulating agents, for example, without limitation, agents that modulate immune checkpoint. In various embodiments, the immune-modulating agent targets one or more of PD-1, PD-L1, and PD-L2. In various embodiments, the immune-modulating agent is PD-1 inhibitor. In various embodiments, the immune-modulating agent is an antibody specific for one or more of PD-1, PD-L1, and PD-L2. For instance, in some embodiments, the immune-modulating agent is an antibody such as, by way of non-limitation, nivolumab, (ONO-4538/BMS-936558, MDX1106, OPDIVO, BRISTOL MYERS SQUIBB), pembrolizumab (KEYTRUDA, MERCK), pidilizumab (CT-011, CURE TECH), MK-3475 (MERCK), BMS 936559 (BRISTOL MYERS SQUIBB), MPDL328OA (ROCHE). In some embodiments, the immune-modulating agent targets one or more of CD137 or CD137L. In various embodiments, the immune-modulating agent is an antibody specific for one or more of CD137 or CD137L. For instance, in some embodiments, the immune-modulating agent is an antibody such as, by way of non-limitation, urelumab (also known as BMS-663513 and anti-4-1BB antibody). In some embodiments, the present chimeric protein is combined with urelumab (optionally with one or more of nivolumab, lirilumab, and urelumab) for the treatment of solid tumors and/or B-cell non-Hodgkins lymphoma and/or head and neck cancer and/or multiple myeloma. In some embodiments, the immune-modulating agent is an agent that targets one or more of CTLA-4, AP2M1, CD80, CD86, SHP-2, and PPP2R5A. In various embodiments, the immune-modulating agent is an antibody specific for one or more of CTLA-4, AP2M1, CD80, CD86, SHP-2, and PPP2R5A. For instance, in some embodiments, the immune-modulating agent is an antibody such as, by way of non-limitation, ipilimumab (MDX-010, MDX-101, Yervoy, BMS) and/or tremelimumab (Pfizer). In some embodiments, the present chimeric protein is combined with ipilimumab (optionally with bavituximab) for the treatment of one or more of melanoma, prostate cancer, and lung cancer. In various embodiments, the immune-modulating agent targets CD20. In various embodiments, the immune-modulating agent is an antibody specific CD20. For instance, in some embodiments, the immune-modulating agent is an antibody such as, by way of non-limitation, Ofatumumab (GENMAB), obinutuzumab (GAZYVA), AME-133v (APPLIED MOLECULAR EVOLUTION), Ocrelizumab (GENENTECH), TRU-015 (TRUBION/EMERGENT), veltuzumab (IMMU-106).

In some embodiments, the present invention relates to combination therapy with one or more chimeric agents described in WO 2013/10779, WO 2015/007536, WO 2015/007520, WO 2015/007542, and WO 2015/007903, the entire contents of which are hereby incorporated by reference in their entireties.

In some embodiments, the chimeric protein described herein, include derivatives that are modified, i.e., by the covalent attachment of any type of molecule to the composition such that covalent attachment does not prevent the activity of the composition. For example, but not by way of limitation, derivatives include composition that have been modified by, inter alia, glycosylation, lipidation, acetylation, pegylation, phosphorylation, amidation, derivatization by known protecting/blocking groups, proteolytic cleavage, linkage to a cellular ligand or other protein, etc. Any of numerous chemical modifications can be carried out by known techniques, including, but not limited to specific chemical cleavage, acetylation, formylation, metabolic synthesis of tunicamycin, etc.

In still other embodiments, the chimeric protein described herein further comprise a cytotoxic agent, comprising, in illustrative embodiments, a toxin, a chemotherapeutic agent, a radioisotope, and an agent that causes apoptosis or cell death. Such agents may be conjugated to a composition described herein.

The chimeric protein described herein may thus be modified post-translationally to add effector moieties such as chemical linkers, detectable moieties such as for example fluorescent dyes, enzymes, substrates, bioluminescent materials, radioactive materials, and chemiluminescent moieties, or functional moieties such as for example streptavidin, avidin, biotin, a cytotoxin, a cytotoxic agent, and radioactive materials.

Illustrative cytotoxic agents include, but are not limited to, methotrexate, aminopterin, 6-mercaptopurine, 6-thioguanine, cytarabine, 5-fluorouracil decarbazine; alkylating agents such as mechlorethamine, thioepa chlorambucil, melphalan, carmustine (BSNU), mitomycin C, lomustine (CCNU), 1-methylnitrosourea, cyclothosphamide, mechlorethamine, busulfan, dibromomannitol, streptozotocin, mitomycin C, cis-dichlorodiamine platinum (II) (DDP) cisplatin and carboplatin (paraplatin); anthracyclines include daunorubicin (formerly daunomycin), doxorubicin (adriamycin), detorubicin, carminomycin, idarubicin, epirubicin, mitoxantrone and bisantrene; antibiotics include dactinomycin (actinomycin D), bleomycin, calicheamicin, mithramycin, and anthramycin (AMC); and antimytotic agents such as the vinca alkaloids, vincristine and vinblastine. Other cytotoxic agents include paclitaxel (taxol), ricin, pseudomonas exotoxin, gemcitabine, cytochalasin B, gramicidin D, ethidium bromide, emetine, etoposide, tenoposide, colchicin, dihydroxy anthracin dione, 1-dehydrotestosterone, glucocorticoids, procaine, tetracaine, lidocaine, propranolol, puromycin, procarbazine, hydroxyurea, asparaginase, corticosteroids, mytotane (O,P'-(DDD)), interferons, and mixtures of these cytotoxic agents.

Further cytotoxic agents include, but are not limited to, chemotherapeutic agents such as carboplatin, cisplatin, paclitaxel, gemcitabine, calicheamicin, doxorubicin, 5-fluorouracil, mitomycin C, actinomycin D, cyclophosphamide, vincristine, bleomycin, VEGF antagonists, EGFR antagonists, platins, taxols, irinotecan, 5-fluorouracil, gemcytabine, leucovorine, steroids, cyclophosphamide, melphalan, vinca alkaloids (e.g., vinblastine, vincristine, vindesine and vinorelbine), mustines, tyrosine kinase inhibitors, radiotherapy, sex hormone antagonists, selective androgen receptor modulators, selective estrogen receptor modulators, PDGF antagonists, TNF antagonists, IL-1 antagonists, interleukins (e.g., IL-12 or IL-2), IL-12R antagonists, Toxin conjugated monoclonal antibodies, tumor antigen specific monoclonal antibodies, Erbitux, Avastin, Pertuzumab, anti-CD20 antibodies, Rituxan, ocrelizumab, ofatumumab, DXL625, HERCEPTIN®, or any combination thereof. Toxic enzymes from plants and bacteria such as ricin, diphtheria toxin and Pseudomonas toxin may be conjugated to the therapeutic agents (e.g., antibodies) to generate cell-type-specific-killing reagents (Youle, et al., Proc. Nat'l Acad. Sci. USA 77:5483 (1980); Gilliland, et al., Proc. Nat'l Acad. Sci. USA 77:4539 (1980); Krolick, et al., Proc. Nat'l Acad. Sci. USA 77:5419 (1980)).

Other cytotoxic agents include cytotoxic ribonucleases as described by Goldenberg in U.S. Pat. No. 6,653,104. Embodiments of the invention also relate to radioimmunoconjugates where a radionuclide that emits alpha or beta particles is stably coupled to the chimeric protein, with or without the use of a complex-forming agent. Such radionuclides include beta-emitters such as Phosphorus-32, Scandium-47, Copper-67, Gallium-67, Yttrium-88, Yttrium-90, Iodine-125, Iodine-131, Samarium-153, Lutetium-177, Rhenium-186 or Rhenium-188, and alpha-emitters such as Astatine-211, Lead-212, Bismuth-212, Bismuth-213 or Actinium-225.

Illustrative detectable moieties further include, but are not limited to, horseradish peroxidase, acetylcholinesterase, alkaline phosphatase, beta-galactosidase and luciferase. Further illustrative fluorescent materials include, but are not limited to, rhodamine, fluorescein, fluorescein isothiocyanate, umbelliferone, dichlorotriazinylamine, phycoerythrin and dansyl chloride. Further illustrative chemiluminescent moieties include, but are not limited to, luminol. Further illustrative bioluminescent materials include, but are not limited to, luciferin and aequorin. Further illustrative radioactive materials include, but are not limited to, Iodine-125, Carbon-14, Sulfur-35, Tritium and Phosphorus-32.

Methods of Treatment

Methods and compositions described herein have application to treating various diseases and disorders, including, but not limited to cancer, infections, immune disorders, anemia, autoimmune diseases, cardiovascular diseases, wound healing, ischemia-related diseases, neurodegenerative diseases, metabolic diseases and many other diseases and disorders.

Further, any of the present agents may be for use in the treating, or the manufacture of a medicament for treating, various diseases and disorders, including, but not limited to cancer, infections, immune disorders, inflammatory diseases or conditions, and autoimmune diseases.

In some embodiments, the present invention relates to the treatment of, or a patient having one or more of chronic granulomatous disease, osteopetrosis, idiopathic pulmonary fibrosis, Friedreich's ataxia, atopic dermatitis, Chagas disease, cancer, heart failure, autoimmune disease, sickle cell disease, thalassemia, blood loss, transfusion reaction, diabetes, vitamin B12 deficiency, collagen vascular disease, Shwachman syndrome, thrombocytopenic purpura, Celiac disease, endocrine deficiency state such as hypothyroidism or Addison's disease, autoimmune disease such as Crohn's Disease, systemic lupus erythematosis, rheumatoid arthritis or juvenile rheumatoid arthritis, ulcerative colitis immune disorders such as eosinophilic fasciitis, hypoimmunoglobulinemia, or thymoma/thymic carcinoma, graft versus host disease, preleukemia, Nonhematologic syndrome (e.g., Down's, Dubowitz, Seckel), Felty syndrome, hemolytic uremic syndrome, myelodysplasic syndrome, nocturnal paroxysmal hemoglobinuria, osteomyelofibrosis, pancytopenia, pure red-cell aplasia, Schoenlein-Henoch purpura, malaria, protein starvation, menorrhagia, systemic sclerosis, liver cirrhosis, hypometabolic states, and congestive heart failure.

In some embodiments, the present invention relates to the treatment of, or a patient having one or more of chronic granulomatous disease, osteopetrosis, idiopathic pulmonary fibrosis, Friedreich's ataxia, atopic dermatitis, Chagas disease, mycobacterial infections, cancer, scleroderma, hepatitis, hepatitis C, septic shock, and rheumatoid arthritis.

In some embodiments, the present invention relates to the treatment of, or a patient having cancer. As used herein, cancer refers to any uncontrolled growth of cells that may interfere with the normal functioning of the bodily organs and systems, and includes both primary and metastatic tumors. Primary tumors or cancers that migrate from their original location and seed vital organs can eventually lead to the death of the subject through the functional deterioration of the affected organs. A metastasis is a cancer cell or group of cancer cells, distinct from the primary tumor location, resulting from the dissemination of cancer cells from the primary tumor to other parts of the body. Metastases may eventually result in death of a subject. For example, cancers can include benign and malignant cancers, polyps, hyperplasia, as well as dormant tumors or micrometastases.

Illustrative cancers that may be treated include, but are not limited to, carcinomas, e.g., various subtypes, including, for example, adenocarcinoma, basal cell carcinoma, squamous cell carcinoma, and transitional cell carcinoma), sarcomas (including, for example, bone and soft tissue), leukemias (including, for example, acute myeloid, acute lymphoblastic, chronic myeloid, chronic lymphocytic, and hairy cell), lymphomas and myelomas (including, for example, Hodgkin and non-Hodgkin lymphomas, light chain, non-secretory, MGUS, and plasmacytomas), and central nervous system cancers (including, for example, brain (e.g., gliomas (e.g., astrocytoma, oligodendroglioma, and ependymoma), meningioma, pituitary adenoma, and neuromas, and spinal cord tumors (e.g., meningiomas and neurofibroma).

Illustrative cancers that may be treated include, but are not limited to, basal cell carcinoma, biliary tract cancer; bladder cancer; bone cancer; brain and central nervous system cancer; breast cancer; cancer of the peritoneum; cervical cancer; choriocarcinoma; colon and rectum cancer; connective tissue cancer; cancer of the digestive system; endometrial cancer; esophageal cancer; eye cancer; cancer of the head and neck; gastric cancer (including gastrointestinal cancer); glioblastoma; hepatic carcinoma; hepatoma; intraepithelial neoplasm; kidney or renal cancer; larynx cancer; leukemia; liver cancer; lung cancer (e.g., small-cell lung cancer, non-small cell lung cancer, adenocarcinoma of the lung, and squamous carcinoma of the lung); melanoma; myeloma; neuroblastoma; oral cavity cancer (lip, tongue, mouth, and pharynx); ovarian cancer; pancreatic cancer; prostate cancer; retinoblastoma; rhabdomyosarcoma; rectal cancer; cancer of the respiratory system; salivary gland carcinoma; sarcoma; skin cancer; squamous cell cancer; stomach cancer; testicular cancer; thyroid cancer; uterine or endometrial cancer; cancer of the urinary system; vulval cancer; lymphoma including Hodgkin's and non-Hodgkin's lymphoma, as well as B-cell lymphoma (including low grade/follicular non-Hodgkin's lymphoma (NHL); small lymphocytic (SL) NHL; intermediate grade/follicular NHL; intermediate grade diffuse NHL; high grade immunoblastic NHL; high grade lymphoblastic NHL; high grade small non-cleaved cell NHL; bulky disease NHL; mantle cell lymphoma; AIDS-related lymphoma; and Waldenstrom's Macroglobulinemia; chronic lymphocytic leukemia (CLL); acute lymphoblastic leukemia (ALL); Hairy cell leukemia; chronic myeloblastic leukemia; as well as other carcinomas and sarcomas; and post-transplant lymphoproliferative disorder (PTLD), as well as abnormal vascular proliferation associated with phakomatoses, edema (e.g., that associated with brain tumors), and Meigs' syndrome.

In some embodiments, the present invention relates to the treatment of, or a patient having a microbial infection and/or chronic infection. Illustrative infections include, but are not limited to, Chagas disease, HIV/AIDS, tuberculosis, osteomyelitis, hepatitis B, hepatitis C, Epstein-Barr virus or parvovirus, T cell leukemia virus, bacterial overgrowth syndrome, fungal or parasitic infections.

In various embodiments, the present compositions are used to treat or prevent one or more inflammatory diseases or conditions, such as inflammation, acute inflammation, chronic inflammation, respiratory disease, atherosclerosis, restenosis, asthma, allergic rhinitis, atopic dermatitis, septic shock, rheumatoid arthritis, inflammatory bowel disease, inflammatory pelvic disease, pain, ocular inflammatory disease, celiac disease, Leigh Syndrome, Glycerol Kinase Deficiency, Familial eosinophilia (FE), autosomal recessive spastic ataxia, laryngeal inflammatory disease; Tuberculosis, Chronic cholecystitis, Bronchiectasis, Silicosis and other pneumoconioses.

In various embodiments, the present compositions are used to treat or prevent one or more autoimmune diseases or conditions, such as multiple sclerosis, diabetes mellitus, lupus, celiac disease, Crohn's disease, ulcerative colitis, Guillain-Barre syndrome, scleroderms, Goodpasture's syndrome, Wegener's granulomatosis, autoimmune epilepsy, Rasmussen's encephalitis, Primary biliary sclerosis, Sclerosing cholangitis, Autoimmune hepatitis, Addison's disease, Hashimoto's thyroiditis, Fibromyalgia, Menier's syndrome; transplantation rejection (e.g., prevention of allograft rejection) pernicious anemia, rheumatoid arthritis, systemic lupus erythematosus, dermatomyositis, Sjogren's syndrome, lupus erythematosus, multiple sclerosis, myasthenia gravis, Reiter's syndrome, Grave's disease, and other autoimmune diseases.

In various embodiments, the present compositions are used to treat, control or prevent cardiovascular disease, such as a disease or condition affecting the heart and vasculature, including but not limited to, coronary heart disease (CHD), cerebrovascular disease (CVD), aortic stenosis, peripheral vascular disease, atherosclerosis, arteriosclerosis, myocardial infarction (heart attack), cerebrovascular diseases (stroke), transient ischemic attacks (TIA), angina (stable and unstable), atrial fibrillation, arrhythmia, valvular disease, and/or congestive heart failure.

In various embodiments, the present compositions are used to treat or prevent one or more metabolic-related disorders. In various embodiments, the present invention is useful for the treatment, controlling or prevention of diabetes, including Type 1 and Type 2 diabetes and diabetes associated with obesity. The compositions and methods of the present invention are useful for the treatment or prevention of diabetes-related disorders, including without limitation diabetic nephropathy, hyperglycemia, impaired glucose tolerance, insulin resistance, obesity, lipid disorders, dyslipidemia, hyperlipidemia, hypertriglyceridemia, hypercholesterolemia, low HDL levels, high LDL levels, atherosclerosis and its sequelae, vascular restenosis, irritable bowel syndrome, inflamatory bowel disease, including Crohn's disease and ulcerative colitis, other inflammatory conditions, pancreatitis, abdominal obesity, neurodegenerative disease, retinopathy, neoplastic conditions, adipose cell tumors, adipose cell carcinomas, such as liposarcoma, prostate cancer and other cancers, including gastric, breast, bladder and colon cancers, angiogenesis, Alzheimer's disease, psoriasis, high blood pressure, Metabolic Syndrome (e.g., a person has three or more of the following disorders: abdominal obesity, hypertriglyceridemia, low HDL cholesterol, high blood pressure, and high fasting plasma glucose), ovarian hyperandrogenism (polycystic ovary syndrome), and other disorders where insulin resistance is a component, such as sleep apnea. The compositions and methods of the present invention are useful for the treatment, control, or prevention of obesity, including genetic or environmental, and obesity-related disorders. The obesity-related disorders herein are associated with, caused by, or result from obesity. Examples of obesity-related disorders include obesity, diabetes, overeating, binge eating, and bulimia, hypertension, elevated plasma insulin concentrations and insulin resistance, dyslipidemia, hyperlipidemia, endometrial, breast, prostate, kidney and colon cancer, osteoarthritis, obstructive sleep apnea, gallstones, heart disease, abnormal heart rhythms and arrythmias, myocardial infarction, congestive heart failure, coronary heart disease, sudden death, stroke, polycystic ovary disease, craniopharyngioma, Prader-Willi Syndrome, Frohlich's syndrome, GH-deficient subjects, normal variant short stature, Turner's syndrome, and other pathological conditions showing reduced metabolic activity or a decrease in resting energy expenditure as a percentage of total fat-free mass, e.g, children with acute lymphoblastic leukemia. Further examples of obesity-related disorders are Metabolic Syndrome, insulin resistance syndrome, reproductive hormone abnormalities, sexual and reproductive dysfunction, such as impaired fertility, infertility, hypogonadism in males and hirsutism in females, fetal defects associated with maternal obesity, gastrointestinal motility disorders, such as obesity-related gastro-esophageal reflux, respiratory disorders, such as obesity-hypoventilation syndrome (Pickwickian syndrome), breathlessness, cardiovascular disorders, inflammation, such as systemic inflammation of the vasculature, arteriosclerosis, hypercholesterolemia, lower back pain, gallbladder disease, hyperuricemia, gout, and kidney cancer, and increased anesthetic risk. The compositions and methods of the present invention are also useful to treat Alzheimer's disease.

In various embodiments, the present compositions are used to treat or prevent one or more respiratory diseases, such as idiopathic pulmonary fibrosis (IPF), asthma, chronic obstructive pulmonary disease (COPD), bronchiectasis, allergic rhinitis, sinusitis, pulmonary vasoconstriction, inflammation, allergies, impeded respiration, respiratory distress syndrome, cystic fibrosis, pulmonary hypertension, pulmonary vasoconstriction, emphysema, Hantavirus pulmonary syndrome (HPS), Loeffler's syndrome, Goodpasture's syndrome, Pleurisy, pneumonitis, pulmonary edema, pulmonary fibrosis, Sarcoidosis, complications associated with respiratory syncitial virus infection, and other respiratory diseases.

In some embodiments, the present invention is used to treat or prevent one or more neurodegenerative disease. Illustrative neurodegenerative disease include, but are not limited to, Friedreich's ataxia, multiple sclerosis (including without limitation, benign multiple sclerosis; relapsing-remitting multiple sclerosis (RRMS); secondary progressive multiple sclerosis (SPMS); progressive relapsing multiple sclerosis (PRMS); and primary progressive multiple sclerosis (PPMS)), Alzheimer's. disease (including, without limitation, Early-onset Alzheimer's, Late-onset Alzheimer's, and Familial Alzheimer's disease (FAD), Parkinson's disease and parkinsonism (including, without limitation, Idiopathic Parkinson's disease, Vascular parkinsonism, Drug-induced parkinsonism, Dementia with Lewy bodies, Inherited Parkinson's, Juvenile Parkinson's), Huntington's disease, Amyotrophic lateral sclerosis (ALS, including, without limitation, Sporadic ALS, Familial ALS, Western Pacific ALS, Juvenile ALS, Hiramaya Disease).

In various embodiments, the present chimeric proteins find use in treating wounds, e.g., a non-healing wound, an ulcer, a burn, or frostbite, a chronic or acute wound, open or closed wound, internal or external wound (illustrative external wounds are penetrating and non-penetrating wound.

In various embodiments, the present chimeric proteins find use in treating ischemia, by way of non-limiting example, ischemia associated with acute coronary syndrome, acute lung injury (ALI), acute myocardial infarction (AMI), acute respiratory distress syndrome (ARDS), arterial occlusive disease, arteriosclerosis, articular cartilage defect, aseptic systemic inflammation, atherosclerotic cardiovascular disease, autoimmune disease, bone fracture, bone fracture, brain edema, brain hypoperfusion, Buerger's disease, burns, cancer, cardiovascular disease, cartilage damage, cerebral infarct, cerebral ischemia, cerebral stroke, cerebrovascular disease, chemotherapy-induced neuropathy, chronic infection, chronic mesenteric ischemia, claudication, congestive heart failure, connective tissue damage, contusion, coronary artery disease (CAD), critical limb ischemia (CLI), Crohn's disease, deep vein thrombosis, deep wound, delayed ulcer healing, delayed wound-healing, diabetes (type I and type II), diabetic neuropathy, diabetes induced ischemia, disseminated intravascular coagulation (DIC), embolic brain ischemia, frostbite, graft-versus-host disease, hereditary hemorrhagic telengiectasiaischemic vascular disease, hyperoxic injury, hypoxia, inflammation, inflammatory bowel disease, inflammatory disease, injured tendons, intermittent claudication, intestinal ischemia, ischemia, ischemic brain disease, ischemic heart disease, ischemic peripheral vascular disease, ischemic placenta, ischemic renal disease, ischemic vascular disease, ischemic-reperfusion injury, laceration, left main coronary artery disease, limb ischemia, lower extremity ischemia, myocardial infarction, myocardial ischemia, organ ischemia, osteoarthritis, osteoporosis, osteosarcoma, Parkinson's disease, peripheral arterial disease (PAD), peripheral artery disease, peripheral ischemia, peripheral neuropathy, peripheral vascular disease, pre-cancer, pulmonary edema, pulmonary embolism, remodeling disorder, renal ischemia, retinal ischemia, retinopathy, sepsis, skin ulcers, solid organ transplantation, spinal cord injury, stroke, subchondral-bone cyst, thrombosis, thrombotic brain ischemia, tissue ischemia, transient ischemic attack (TIA), traumatic brain injury, ulcerative colitis, vascular disease of the kidney, vascular inflammatory conditions, von Hippel-Lindau syndrome, or wounds to tissues or organs In various embodiments, the present invention relates to the treatment of one or more of anemia, including anemia resulting from chronic kidney disease (e.g., from dialysis) and/or an anti-cancer agent (e.g., chemotherapy and/or HIV treatment (e.g., Zidovudine (INN) or azidothymidine (AZT)), inflammatory bowel disease (e.g., Crohn's disease and ulcer colitis), anemia linked to inflammatory conditions (e.g., arthritis, lupus, IBD), anemia linked to diabetes, schizophrenia, cerebral malaria, as aplastic anemia, and myelodysplasia from the treatment of cancer (e.g., chemotherapy and/or radiation), and various myelodysplastic syndrome diseases (e.g., sickle cell anemia, hemoglobin SC disease, hemoglobin C disease, alpha- and beta-thalassemias, neonatal anemia after premature birth, and comparable conditions).

In some embodiments, the present invention relates to the treatment of, or a patient having anemia, i.e., a condition in which the number of red blood cells and/or the amount of hemoglobin found in the red blood cells is below normal. In various embodiments, the anemia may be acute or chronic. For example, the present anemias include but are not limited to iron deficiency anemia, renal anemia, anemia of chronic diseases/inflammation, pernicious anemia such as macrocytic achylic anemia, juvenile pernicious anemia and congenital pernicious anemia, cancer-related anemia, anti-cancer-related anemia (e.g., chemotherapy-related anemia, radiotherapy-related anemia), pure red cell aplasia, refractory anemia with excess of blasts, aplastic anemia, X-lined siderobalstic anemia, hemolytic anemia, sickle cell anemia, anemia caused by impaired production of ESA, myelodysplasia syndromes, hypochromic anemia, microcytic anemia, sideroblastic anemia, autoimmune hemolytic anemia, Cooley's anemia, Mediterranean anemia, Diamond Blackfan anemia, Fanconi's anemia and drug-induced immune hemolytic anemia. Anemia may cause serious symptoms, including hypoxia, chronic fatigue, lack of concentration, pale skin, low blood pressure, dizziness and heart failure.

In some embodiments, the present invention relates to the treatment of anemia resulting from chronic renal failure. In some embodiments, the present invention relates to the treatment of anemia resulting from the use of one or more renal replacement therapies, inclusive of dialysis, hemodialysis, peritoneal dialysis, hemofiltration, hemodiafiltration, and renal transplantation.

In some embodiments, the present invention relates to the treatment of anemia in patients with chronic kidney disease who are not on dialysis. For instance, the present invention relates to patients in stage 1 CKD, or stage 2 CKD, or stage 3 CKD, or stage 4 CKD, or stage 5 CKD. In some embodiments, the present patient is stage 4 CKD or stage 5 CKD. In some embodiments, the present patient has undergone a kidney transplant. In some embodiments, the present invention relates to the treatment of anemia is a patient having an acute kidney injury (AKI).

In some embodiments, the anemia is induced by chemotherapy. For instance, the chemotherapy may be any myelosuppressive chemotherapy. In some embodiment, the chemotherapy is one or more of Revlimid, Thalomid, dexamethasone, Adriamycin and Doxil. In some embodiments, the chemotherapy is one or more platinum-based drugs including cisplatin (e.g., PLATINOL) and carboplatin (e.g., PARAPLATIN). In some embodiments, the chemotherapy is any one of the chemotherapeutic agents described herein. In some embodiments, the chemotherapy is any agent described in Groopman et al. J Natl Cancer Inst (1999) 91 (19): 1616-1634, the contents of which are hereby incorporated by reference in their entireties. In some embodiments, the present compositions and methods are used in the treatment of chemotherapy-related anemia in later stage cancer patients (e.g., a stage IV, or stage III, or stage II cancer). In some embodiments, the present compositions and methods are used in the treatment of chemotherapy-related anemia in cancer patients receiving dose-dense chemotherapy or other aggressive chemotherapy regimens.

In some embodiments, the present invention relates to the treatment of anemia in a patient having one or more blood-based cancers, such as leukemia, lymphoma, and multiple myeloma. Such cancers may affect the bone marrow directly. Further, the present invention relates to metastatic cancer that has spread to the bone or bone marrow. In some embodiments, the present invention relates to the treatment of anemia in a patient undergoing radiation therapy. Such radiation therapy may damage the bone marrow, lowering its ability to make red blood cells. In further embodiments, the present invention relates to the treatment of anemia in a patient having a reduction or deficiency of one or more of iron, vitamin B12, and folic acid. In further embodiments, the present invention relates to the treatment of anemia in a patient having excessive bleeding including without limitation, after surgery or from a tumor that is causing internal bleeding. In further embodiments, the present invention relates to the treatment of anemia in a patient having anemia of chronic disease.

In some embodiments, the present methods and compositions stimulate red blood cell production. In some embodiments, the present methods and compositions stimulate division and differentiation of committed erythroid progenitors in the bone marrow.

Certain embodiments of the present invention are particularly useful for treating chemotherapy-induced anemia in cancer patients. In some embodiments, the present methods and compositions allows for continued administration of the chimeric protein after a cancer patient's chemotherapy is finished. In some embodiments, the present methods and compositions allows for treatment of a cancer patient without dose reduction relative to a non-cancer patient. In some embodiments, the present methods and compositions allows for treatment of a cancer patient receiving chemotherapy and considered curable. In various embodiments, the cancer patient has one or more of a history of blood clots, recent surgery, prolonged periods of bed rest or limited activity, and treatment with a chemotherapeutic agent.

Kits

The invention also provides kits for the administration of any agent described herein (e.g., the chimeric protein with or without various additional therapeutic agents). The kit is an assemblage of materials or components, including at least one of the inventive pharmaceutical compositions described herein. Thus, in some embodiments, the kit contains at least one of the pharmaceutical compositions described herein.

The exact nature of the components configured in the kit depends on its intended purpose. In one embodiment, the kit is configured for the purpose of treating human subjects.

Instructions for use may be included in the kit. Instructions for use typically include a tangible expression describing the technique to be employed in using the components of the kit to effect a desired outcome, such as to treat cancer.

Optionally, the kit also contains other useful components, such as, diluents, buffers, pharmaceutically acceptable carriers, syringes, catheters, applicators, pipetting or measuring tools, bandaging materials or other useful paraphernalia as will be readily recognized by those of skill in the art.

The materials and components assembled in the kit can be provided to the practitioner stored in any convenience and suitable ways that preserve their operability and utility. For example, the components can be provided at room, refrigerated or frozen temperatures. The components are typically contained in suitable packaging materials. In various embodiments, the packaging material is constructed by well-known methods, preferably to provide a sterile, contaminant-free environment. The packaging material may have an external label which indicates the contents and/or purpose of the kit and/or its components.

Definitions

As used herein, "a," "an," or "the" can mean one or more than one.

Unless specifically stated or obvious from context, as used herein, the term "or" is understood to be inclusive and covers both "or" and "and".

Further, the term "about" when used in connection with a referenced numeric indication means the referenced numeric indication plus or minus up to 10% of that referenced numeric indication, e.g., within (plus or minus) 10%, 9%, 8%, 7%, 6%, 5%, 4%, 3%, 2%, 1%, 0.5%, 0.1%, 0.05%, or 0.01% of the stated value. For example, the language "about 50" covers the range of 45 to 55.

An "effective amount," when used in connection with medical uses is an amount that is effective for providing a measurable treatment, prevention, or reduction in the rate of pathogenesis of a disease of interest.

As used herein, something is "decreased" if a read-out of activity and/or effect is reduced by a significant amount, such as by at least about 10%, at least about 20%, at least about 30%, at least about 40%, at least about 50%, at least about 60%, at least about 70%, at least about 80%, at least about 90%, at least about 95%, at least about 97%, at least about 98%, or more, up to and including at least about 100%, in the presence of an agent or stimulus relative to the absence of such modulation. As will be understood by one of ordinary skill in the art, in some embodiments, activity is decreased and some downstream read-outs will decrease but others can increase.

Conversely, activity is "increased" if a read-out of activity and/or effect is increased by a significant amount, for example by at least about 10%, at least about 20%, at least about 30%, at least about 40%, at least about 50%, at least about 60%, at least about 70%, at least about 80%, at least about 90%, at least about 95%, at least about 97%, at least about 98%, or more, up to and including at least about 100% or more, at least about 2-fold, at least about 3-fold, at least about 4-fold, at least about 5-fold, at least about 6-fold, at least about 7-fold, at least about 8-fold, at least about 9-fold, at least about 10-fold, at least about 50-fold, at least about 100-fold, in the presence of an agent or stimulus, relative to the absence of such agent or stimulus.

As referred to herein, all compositional percentages are by weight of the total composition, unless otherwise specified. As used herein, the word "include," and its variants, is intended to be non-limiting, such that recitation of items in a list is not to the exclusion of other like items that may also be useful in the compositions and methods of this technology. Similarly, the terms "can" and "may" and their variants are intended to be non-limiting, such that recitation that an embodiment can or may comprise certain elements or features does not exclude other embodiments of the present technology that do not contain those elements or features.

Although the open-ended term "comprising," as a synonym of terms such as including, containing, or having, is used herein to describe and claim the invention, the present invention, or embodiments thereof, may alternatively be described using alternative terms such as "consisting of" or "consisting essentially of."

As used herein, the words "preferred" and "preferably" refer to embodiments of the technology that afford certain benefits, under certain circumstances. However, other embodiments may also be preferred, under the same or other circumstances. Furthermore, the recitation of one or more preferred embodiments does not imply that other embodiments are not useful, and is not intended to exclude other embodiments from the scope of the technology.

The amount of compositions described herein needed for achieving a therapeutic effect may be determined empirically in accordance with conventional procedures for the particular purpose. Generally, for administering therapeutic agents for therapeutic purposes, the therapeutic agents are given at a pharmacologically effective dose. A "pharmacologically effective amount," "pharmacologically effective dose," "therapeutically effective amount," or "effective amount" refers to an amount sufficient to produce the desired physiological effect or amount capable of achieving the desired result, particularly for treating the disorder or disease. An effective amount as used herein would include an amount sufficient to, for example, delay the development of a symptom of the disorder or disease, alter the course of a symptom of the disorder or disease (e.g., slow the progression of a symptom of the disease), reduce or eliminate one or more symptoms or manifestations of the disorder or disease, and reverse a symptom of a disorder or disease. Therapeutic benefit also includes halting or slowing the progression of the underlying disease or disorder, regardless of whether improvement is realized.

Effective amounts, toxicity, and therapeutic efficacy can be determined by standard pharmaceutical procedures in cell cultures or experimental animals, e.g., for determining the LD50 (the dose lethal to about 50% of the population) and the ED50 (the dose therapeutically effective in about 50% of the population). The dosage can vary depending upon the dosage form employed and the route of administration utilized. The dose ratio between toxic and therapeutic effects is the therapeutic index and can be expressed as the ratio LD50/ED50. In some embodiments, compositions and methods that exhibit large therapeutic indices are preferred. A therapeutically effective dose can be estimated initially from in vitro assays, including, for example, cell culture assays. Also, a dose can be formulated in animal models to achieve a circulating plasma concentration range that includes the IC50 as determined in cell culture, or in an appropriate animal model. Levels of the described compositions in plasma can be measured, for example, by high performance liquid chromatography. The effects of any particular dosage can be monitored by a suitable bioassay. The dosage can be determined by a physician and adjusted, as necessary, to suit observed effects of the treatment.

In certain embodiments, the effect will result in a quantifiable change of at least about 10%, at least about 20%, at least about 30%, at least about 50%, at least about 70%, or at least about 90%. In some embodiments, the effect will result in a quantifiable change of about 10%, about 20%, about 30%, about 50%, about 70%, or even about 90% or more. Therapeutic benefit also includes halting or slowing the progression of the underlying disease or disorder, regardless of whether improvement is realized.

As used herein, "methods of treatment" are equally applicable to use of a composition for treating the diseases or disorders described herein and/or compositions for use and/or uses in the manufacture of a medicaments for treating the diseases or disorders described herein. This invention is further illustrated by the following non-limiting examples.

EXAMPLES

Potential mutations in human interferon γ that could lead to loss of interaction with the IFNγ receptor, e.g., the IFNγ receptor 1 or 2 subunit, and for which the interaction and receptor activation could be restored via an AcTakine (i.e., a chimera of a signaling agent and a targeting agent) effect were chosen based on homology modeling and structure analysis of related interferon receptor complexes.

Example 1: Identification of IFN-γ Contact Residues for Interaction with IFN-γ Receptor 1 Subunit Homology models for the complex of human IFN-γ with the IFN-γ receptor 1 subunit were constructed.

A list of contact residues between IFN-γ with the IFN-γ receptor 1 subunit is examined. Based on this analysis, the side chains of these residues were mutated to remove the contacts, without introducing steric hindrance.

Example 2: Construction and Characterization of IFN-γ-Containing Chimeric Proteins In this example, chimeric proteins comprising a recombinant heavy-chain-only antibody (VHH) which targets human CD20, a flexible 20*Gly-Gly-Ser linker, and a modified human IFNgamma (hIFN-γ) were constructed and characterized.

Mutants in hIFN-γ in amino acid sites that were believed to affect binding of hIFN-γ to the interferon gamma receptor 1 (IFNGR1) were made using standard site-directed mutagenesis of wild type (referred to herein as P-552 and as having the amino acid sequence SEQ ID NO: 947). With respect to SEQ ID NO: 947, the point mutations included: V22A, A23G, A23G+D24G, D24G, H111A, H111D, I114A, Q115A, A118G, and I114A+A118G. The nine mutants are referred to herein as, respectively, P-667 to P-676; the modified hIFN-γs having amino acid sequences, respectively, of SEQ ID NO: 953 to SEQ ID NO: 962). Also, five C-terminal deletions of hIFN-γ were made: a 5 amino acid deletion (Δc5), a 7 amino acid deletion (Δc7), a 14 amino acid deletion (Δc14), a 15 amino acid deletion (Δc15), and a 16 amino acid deletion (Δc16). The five C-terminal deletions are referred to herein as, respectively, P-662 to P-666; the modified hIFN-γs having amino acid sequences, respectively, of SEQ ID NO: 948 to SEQ ID NO: 952). Note that each of the wild type hIFN-γ and modified hIFN-γs used in this example lacked hIFN-γ's N-terminal signal sequence; compare SEQ ID NO: 946 to SEQ ID NO: 947. Exemplary modified hIFN-γs are shown in FIG. 1.

The coding sequence for the chimeric protein hCD20 VHH-(GGS)$_{20}$-wild type hIFN-γ-6×His or for a chimeric protein hCD20 VHH-(GGS)$_{20}$-modified hIFN-γ-6×His was cloned in the pMTW vector for mammalian expression. The resulting constructs were transfected into Hek293T cells using polyethylenimine. Proteins were purified from the supernatants using the Ni Sepharose® excel (GE Healthcare); imidazole was removed from the samples using PD10 columns (GE Healthcare).

The effect of each IFN-γ mutation was initially tested in a GAS-luciferase reporter assay, which reported that a cell's IFNGR1 has been bound by IFN-γ. Using the pGAS-TA-luciferase reporter, the ability of chimeric proteins comprising wild type or modified hIFN-γ to induce STAT1 signaling was compared in CD20-positive Hek293T cells and CD20-negative (mock) Hek293T cells. Here, using calcium phosphate, cells were transfected with the GAS-luciferase reporter with or without a CD20-expressing plasmid. Two days after transfection, cells were resuspended and stimulated overnight with a serial dilution (as indicated in FIG. 2A to FIG. 2P) of a chimeric protein comprising the wild type or a mutant IFN-γ. Luciferase was measured using an EnSight™ reader (Perkin Elmer).

As shown in FIG. 2D to FIG. 2H and FIG. 2P, the 14 amino acid deletion, the 15 amino acid deletion, and the 16 amino acid deletion variants (respectively, P-664, P-665, and P-666), the V22A single point mutant (P-667), the A23G single point mutant (P-668), the double point mutant A23G-D24G (P-669), the D24G single point mutant (P-670), and the double point mutant I114A-A118G (P-676) had increased luciferase signal in cells that express CD20 versus cells that were mock transfected. Thus, these chimeric proteins, which comprise a CD20 targeting moiety, specifically activate signaling in cells that expressed CD20 on their surfaces.

The effects of the IFN-γ mutations were then tested in a second assay that detects STAT1 phosphorylation, which is an indicator that a cell's IFNGR1 has been bound by IFN-γ. Here, Hek293T were transfected with a CD20-expression plasmid (CD20 positive) or an empty vector (CD20 negative). Two days after transfection, cells were stimulated for 15 minutes at 37° C. with a serial dilution (as indicated in FIG. 3A to FIG. 3H) of a chimeric protein comprising the wild type or a mutant IFN-γ. Afterwards, the cells were fixed (10 minutes, 37° C., Fix Buffer I; BD Biosciences), were permeabilized (30 minutes, on ice, Perm III Buffer I; BD Biosciences), were washed, and then were stained with an anti-STAT1 pY701 Antibody (BD Biosciences). Data was acquired with a FACSCalibur™ (BD Biosciences) and analyzed with FlowJo® software (FlowJo, LLC).

As shown in FIG. 3B to FIG. 3D and FIG. 3F, the 14 amino acid deletion, the 15 amino acid deletion, and the 16 amino acid deletion variants (respectively, P-664, P-665, and P-666) and the double point mutant A23G-D24G (P-669) induce STAT1 phosphorylation in cells that were CD20 positive versus cells that were mock transfected (CD20 negative). Thus, these four chimeric proteins specifically activate signaling in cells that expressed CD20 on their surfaces.

Figure 3A:
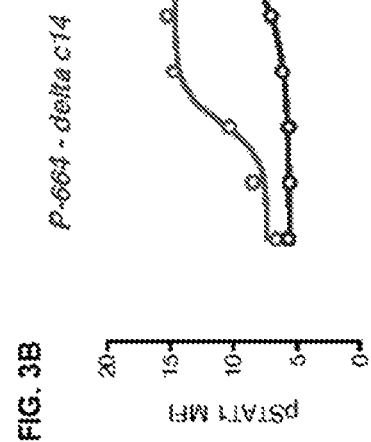
Figure 3B:
Figure 3C:
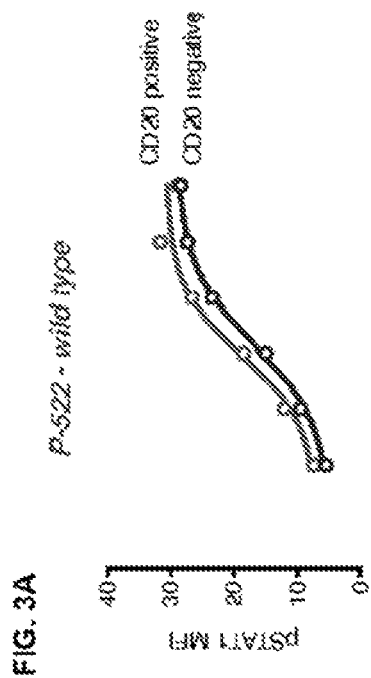
Figure 3D:
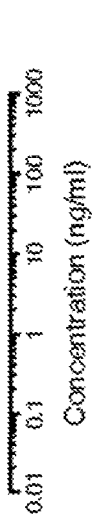
Figure 3F:
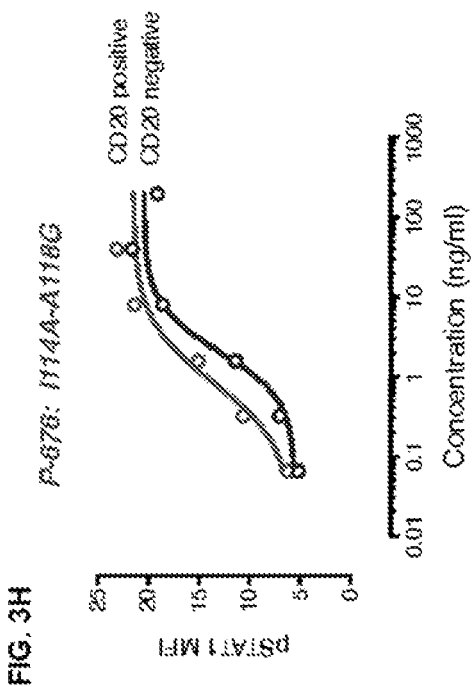
Figure 3H:
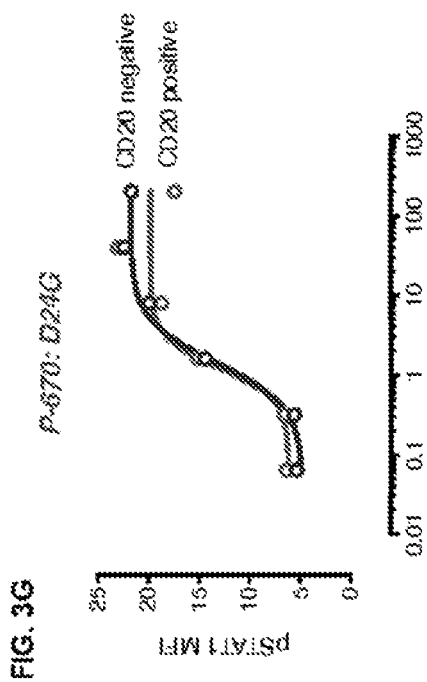
Figure 3E:
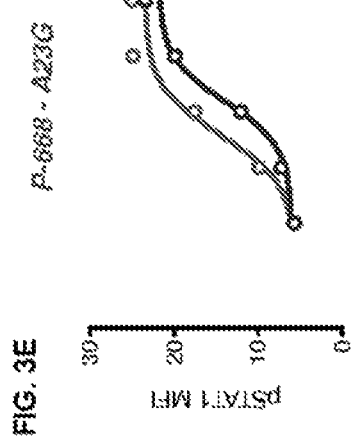
Figure 3G:
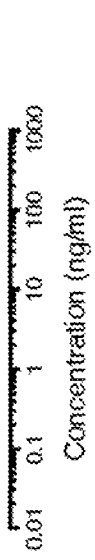

Conversely, the A23G single point mutant (P-668; FIG. 3E), the D24G single point mutant (P-670; FIG. 3G), and the double point mutant I114A-A118G (P-676; FIG. 3H) induced equivalent STAT1 phosphorylation in cells that express CD20 and in cells that were mock transfected. Thus, these other three chimeric proteins nonspecifically activate signaling in the second assay even though they specifically activated signaling in the first assay.

Using two different experimental assays, chimeric proteins comprising an anti-human CD20 VHH and one of three INF-γ deletions (Δc14, Δc15, and Δc16) or a double point-mutant (A23G-D24G) specifically bind to and activate IFNGR1 on CD20 expressing cells.

EQUIVALENTS

While the invention has been described in connection with specific embodiments thereof, it will be understood that it is capable of further modifications and this application is intended to cover any variations, uses, or adaptations of the invention following, in general, the principles of the invention and including such departures from the present disclosure as come within known or customary practice within the art to which the invention pertains and as may be applied to the essential features hereinbefore set forth and as follows in the scope of the appended claims.

Those skilled in the art will recognize, or be able to ascertain, using no more than routine experimentation, numerous equivalents to the specific embodiments described specifically herein. Such equivalents are intended to be encompassed in the scope of the following claims.

INCORPORATION BY REFERENCE

All patents and publications referenced herein are hereby incorporated by reference in their entireties.

The publications discussed herein are provided solely for their disclosure prior to the filing date of the present application. Nothing herein is to be construed as an admission that the present invention is not entitled to antedate such publication by virtue of prior invention.

As used herein, all headings are simply for organization and are not intended to limit the disclosure in any manner. The content of any individual section may be equally applicable to all sections.

SEQUENCE LISTING (962 sequences)

SEQ ID NO: 1 - protein, 235 aa, Artificial Sequence
  Synthetic Sequence
MALPVTALLLPLALLLHAARPSQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRRRVCKCPRPVVKSGDKPSLSARYV

SEQ ID NO: 2 - protein, 198 aa, Artificial Sequence
  Synthetic Sequence
MALPVTALLLPLALLLHAARPSQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAGNRRRVCKCPRPVVKSGDKPSLSARYV

SEQ ID NO: 3 - protein, 276 aa, Artificial Sequence
  Synthetic Sequence
MRNQAPGRPKGATFPPRRPTGSRAPPLAPELRAKQRPGERVMALPVTALLLPLALLLHAARPSQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRRRVCKCPRPVVKSGDKPSLSARYV

SEQ ID NO: 4 - protein, 210 aa, Artificial Sequence
  Synthetic Sequence
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQFYK

SEQ ID NO: 5 - protein, 221 aa, Artificial Sequence
  Synthetic Sequence
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQLRLHPLEKCSRMDY

SEQ ID NO: 6 - protein, 213 aa, Artificial Sequence
  Synthetic Sequence
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGRRRRARLRFMKQPQGEGISGTFVPQCLHGYYSNTTTSQKLLNPWILKT

SEQ ID NO: 7 - protein, 246 aa, Artificial Sequence
  Synthetic Sequence
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQKFNIVCLKISGFTTCCCFQILQISREYGFGVLLQKDIGQ

SEQ ID NO: 8 - protein, 243 aa, Artificial Sequence
  Synthetic Sequence
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQPQGEGISGTFVPQCLHGYYSNTTTSQKLLNPWILKT

SEQ ID NO: 9 - protein, 180 aa, Artificial Sequence
  Synthetic Sequence
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGRRRRARLRFMKQFYK

SEQ ID NO: 10 - protein, 206 aa, Artificial Sequence
  Synthetic Sequence
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKDFTNKQRIGFWCPATKRHRSVMSTMWKNERRDTFNPGEFNGC

SEQ ID NO: 11 - protein, 198 aa, Artificial Sequence
  Synthetic Sequence
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGLKGKVYQEPLSPNACMDTTAILQPHRSCLTHGS

SEQ ID NO: 12 - protein, 118 aa, Artificial Sequence
  Synthetic Sequence
EVQLVESGGGLVQPGGSLRLSCAASGFNIKDTYIHWVRQAPGKGLEWVARIDPANDNTLYASKFQGRATISADTSKNTAYLQMNSLRAEDTAVYYCGRGYGYYVFDHWGQGTLVTVSS

SEQ ID NO: 13 - protein, 118 aa, Artificial Sequence
  Synthetic Sequence
QVQLVQSGAEVKKPGATVKISCKVSGFNIKDTYIHWVQQAPGKGLEWMGRIDPANDNTLYASKFQGRVTITADTSTDTAYMELSSLRSEDTAVYYCARGYGYYVFDHWGQGTLVTVSS

SEQ ID NO: 14 - protein, 107 aa, Artificial Sequence
  Synthetic Sequence
DVQITQSPSSLSASVGDRVTITCRTSRSISQYLAWYQQKPGKVPKLLIYSGSTLQSGVPSRFSGSGSGTDFTLTISSLQPEDVATYYCQQHNENPLTFGGGTKVEIK

SEQ ID NO: 15 - protein, 450 aa, Artificial Sequence
  Synthetic Sequence
QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSAKTTAPSVYPLAPVCGGTTGSSVTLGCLVKGYFPEPVTLTWNSGSLSSGVHTFPAVLQSDLYTLSSSVTVTSSTWPSQSITCNVAHPASSTKVDKKIEPRPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16 - protein, 213 aa, Artificial Sequence
  Synthetic Sequence
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRADTAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 17 - protein, 449 aa, Artificial Sequence
  Synthetic Sequence
EVQLLESGGGLVQPGGSLRLSCAASGFTFSSFPMAWVRQAPGKGLEWVSTISTSGGRTYYRDSVKGRFTISRDNSKNTLYLQMNSLRAEDTAVYYCAKFRQYSGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18 - protein, 216 aa, Artificial Sequence
  Synthetic Sequence
DIQLTQPNSVSTSLGSTVKLSCTLSSGNIENNYVHWYQLYEGRSPTTMIYDDDKRPDGVPDRFSGSIDRSSNSAFLTIHNVAIEDEAIYFCHSYVSSFNVFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 19 - protein, 449 aa, Artificial Sequence
  Synthetic Sequence
QVQLVQSGGGVVQPGRSLRLSCKASGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20 - protein, 213 aa, Artificial Sequence
  Synthetic Sequence
DIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21 - protein, 120 aa, Artificial Sequence [sequence omitted]

SEQ ID NO: 22 - protein, 106 aa, Artificial Sequence [sequence omitted]

SEQ ID NO: 23 - protein, 118 aa, Artificial Sequence [sequence omitted]

SEQ ID NO: 24 - protein, 118 aa, Artificial Sequence
  Synthetic Sequence
QVQLVQSGGGVVQSGRSLRLSCAASGFKFSGYGMHWVRQAPGKGLEWVAVIWYDGSKKYYVDSVKGRFTISRDNSKNTLYLQMNSLRGEDTAVYYCARQMGYWHFDLWGRGTLVTVSS

SEQ ID NO: 25 - protein, 108 aa, Artificial Sequence [sequence omitted]

SEQ ID NO: 26 - protein, 125 aa, Artificial Sequence
  Synthetic Sequence
EVKLVESGGGLVQPGGSLRLSCAASGFTFNTYAMNWVRQAPGKGLEWVARIRSKYNNYATYYADSVKDRFTISRDDSKSSLYLQMNNLKTEDTAMYYCVRHGNFGNSYVSWFAYWGQGTLVTVSS

SEQ ID NO: 27 - protein, 125 aa, Artificial Sequence
  Synthetic Sequence
EVKLVESGGGLVKPGRSLRLSCAASGFTFNTYAMNWVRQAPGKGLEWVARIRSKYNNYATYYADSVKDRFTISRDDSKSILYLQMNNLKTEDTAMYYCVRHGNFGNSYVSWFAYWGQGTLVTVSS

SEQ ID NO: 28 - protein, 125 aa, Artificial Sequence
  Synthetic Sequence
EVKLVESGGGLVKPGRSLRLSCAASGFTFNTYAMNWVRQAPGKGLEWVARIRSKYNNYATYYADSVKDRFTISRDDSKSILYLQMNSLKTEDTAMYYCVRHGNFGNSYVSWFAYWGQGTLVTVSS

SEQ ID NO: 29 - protein, 125 aa, Artificial Sequence
  Synthetic Sequence
EVKLVESGGGLVKPGRSLRLSCAASGFTFNTYAMNWVRQAPGKGLEWVARIRSKYNNYATYYADSVKDRFTISRDDSKSILYLQMNSLKTEDTAMYYCVRHGNFGNSYVSWFAYWGQGTMVTVSS

SEQ ID NO: 30 - protein, 109 aa, Artificial Sequence
  Synthetic Sequence
QAVVTQEPSFSVSPGGTVTLTCRSSTGAVTTSNYANWVQQTPGQAFRGLIGGTNKRAPGVPARFSGSLIGDKAALTITGAQADDESIYFCALWYSNLWVFGGGTKLTVL

SEQ ID NO: 31 - protein, 109 aa, Artificial Sequence
  Synthetic Sequence
QAVVTQEPSFSVSPGGTVTLTCRSSTGAVTTSNYANWVQQTPGQAFRGLIGGTNKRAPGVPARFSGSILGNKAALTITGAQADDESIYFCALWYSNLWVFGGGTKLTVL

SEQ ID NO: 32 - protein, 109 aa, Artificial Sequence
  Synthetic Sequence
QAVVTQEPSFSVSPGGTVTLTCRSSTGAVTTSNYANWVQQTPGQAFRGLIGGTNKRAPGVPARFSGSILGNKAALTITGAQADDESDYYCALWYSNLWVFGGGTKLTVL

SEQ ID NO: 33 - protein, 119 aa, Artificial Sequence
  Synthetic Sequence
QVQLVQSGSELKKPGASVKMSCKASGYTFTRYTMHWVRQAPGKGLEWIGYINPSRGYTNYNQKFKDRATLTTDKSTSTAYMQLSSLRSEDTAVYYCARYYDDHYSLDYWGQGTLVTVSS

SEQ ID NO: 34 - protein, 106 aa, Artificial Sequence
  Synthetic Sequence
QIVLTQSPATLSLSPGERATMSCSASSSVSYMNWYQQKPGKAPKRWIYDTSKLASGVPSRFRGSGSGTDYTLTISSLQPEDFATYYCQQWSSNPFTFGGGTKVEIK

SEQ ID NO: 35 - protein, 125 aa, Artificial Sequence
  Synthetic Sequence
ELQLVESGGGVVQPGRSLRLSCAASGFTFSSYGMHWVRQAPGKGLEWVAVISYDGSNKYYADSVKGRFTISRDNSKNTLYLQMNSLRSEDTAVYYCARLSPYCTNGVCWDAFDIWGQGTMVTVSS

SEQ ID NO: 36 - protein, 122 aa, Artificial Sequence
  Synthetic Sequence
ELQLVESGGGLVKPGRSLRLSCTASGFTFGDYAMSWFRQAPGKGLEWVGFIRSKAYGGTTEYAASVKGRFTISRDDSKSIAYLQMNSLKTEDTAVYYCTPQLWLLQDAFDIWGQGTMVTVSS

SEQ ID NO: 37 - protein, 120 aa, Artificial Sequence
  Synthetic Sequence
ELQLVESGPGLVKPSGTLSLTCAVSGGSISSRNWWSWVRQPPGKGLEWIGDIYHSGSTNYNPSLKSRVTISVDKSKNQFSLKLSSVTAADTAVYYCASGYTSCRDAFDIWGQGTMVTVSS

SEQ ID NO: 38 - protein, 126 aa, Artificial Sequence
  Synthetic Sequence
ELQLVEWGAGLLKPSETLSLTCAVYGGSFSGYYWSWIRQPPGKGLEWIGEINHSGSTNYNPSLKSRVTISVDTSKNQFSLKLSSVTAADTAVYYCARGRGRFLGWLLGGSNWFDPWGQGTLVTVSS

SEQ ID NO: 39 - protein, 119 aa, Artificial Sequence
  Synthetic Sequence
ELQLVEWGAGLLKPSETLSLTCAVYGGSFSGYYWSWIRQPPGKGLEWIGEINHSGSTNYNPSLKSRVTISVDTSKNQFSLKLSSVTAADTAVYYCARGPDRMGHGFDIWGQGTMVTVSS

SEQ ID NO: 40 - protein, 127 aa, Artificial Sequence
  Synthetic Sequence
ELQLVESGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDRRRIAARQYYGMDVWGQGTTVTVSS

SEQ ID NO: 41 - protein, 121 aa, Artificial Sequence
  Synthetic Sequence
ELQLVESGGGLVQPGGSLRLSCAASGFTFSSYAMGWVRQAPGKGLEWVSAVSGSGGSTYYADSVKGRFTISRDNSKNTLYLQMNSLRAEDTAVYYCAKAKFLGHYYGMDVWGQGTTVTVSS

SEQ ID NO: 42 - protein, 123 aa, Artificial Sequence
  Synthetic Sequence
ELQLVESGPVLVKPTDTLTLTCTVSGFSLNNPRMGVSWIRQPPGKTLEWLAHIFPSDAKAHSASLKSRLTISKDTSKSQVVPTMTNMDPVDTATYYCARILGEYYPPAWFDPWGQGTLVTVSS

SEQ ID NO: 43 - protein, 107 aa, Artificial Sequence
  Synthetic Sequence
ELQMTQSPSSLSASVGDRVSITCRASQTISNYLNWYQLKPGKAPKLLIYAASTLQSEVPTRFSGSGSGTDFTLTISGLHPEDFATYYCQQFNSYPRTFGQGTKVEIK

SEQ ID NO: 44 - protein, 107 aa, Artificial Sequence
  Synthetic Sequence
ELQMTQSPSSLSASVGDRVTITCRASQGISNYLAWYQQKPGKVPKLLIYAASTLQSGVPSRFSGSGSGTDFTLTISSLQPEDFATYYCQQSYSTPPTFGQGTKLEIK

SEQ ID NO: 45 - protein, 107 aa, Artificial Sequence
  Synthetic Sequence
ELVMTQSPSSLSASVGDRVTITCRASQGIGNYLAWYQQKPGQPPKMLIYWASIRESGVPDRFSGSGSGTDFTLTISSLQAEDVAVYYCQQYYSNPQTFGQGTKVEIK

SEQ ID NO: 46 - protein, 107 aa, Artificial Sequence
  Synthetic Sequence
ELVMTQSPSSLSASVGDRVTITCRASQGISNYLNWYQQKPGKAPKLLIYDASNLETGVPSRFSGSGSGTDFTLTISSLQPEDFATYYCQQSYSTPYTFGQGTKVDIK

SEQ ID NO: 47 - protein, 107 aa, Artificial Sequence
  Synthetic Sequence
ELQMTQSPSSLSASVGDRVTITCRASQSISSYLNWYQQKSGKAPKLLIYAASSLQSGVPSRFSGSGSGTDFTLTISSLQPEDFATYYCQQSYSSPWTFGQGTKVEIK

SEQ ID NO: 48 - protein, 108 aa, Artificial Sequence
  Synthetic Sequence
ELVLTQSPGTLSLSPGERATLSCRASQSVSSNYLAWYQQKPGQAPRLLIYGASSRATGIPDRFSGSGSGTDFTLTISSLQPEDVATYYCQKYNSAPLTFGGGTKVEIK

SEQ ID NO: 49 - protein, 107 aa, Artificial Sequence
  Synthetic Sequence
ELQMTQSPSSLSASVGDRVTITCRASQSISSYLNWYQQKPGKAPKLLIYAASSLQSGVPSRFSGSGSGTEFTLTISSLQPEDFATYYCLQHNAYPYTFGQGTKVEIK

SEQ ID NO: 50 - protein, 113 aa, Artificial Sequence
  Synthetic Sequence
ELVMTQSPDSLAVSLGERATINCKSSQSVLYSSNNKNYLAWYQQKPGQPPKLLIYWASTRESGVPDRFSGSGSGTDFTLTISSLQAEDVAVYYCQQYLKIPYTFGQGTKVEIK

SEQ ID NO: 51 - protein, 119 aa, Artificial Sequence
  Synthetic Sequence
QVQLVQSGAEVKKPGASVKVSCKASGYTFTRYTMHWVRQAPGQGLEWMGYINPSRGYTNYNQKFKDRVTMTTDTSISTAYMELSRLRSDDTAVYYCARYYDDHYCLDYWGQGTLVTVSS

SEQ ID NO: 52 - protein, 119 aa, Artificial Sequence
  Synthetic Sequence
QVQLVQSGAEVKKPGASVKVSCKASGYTFTRYTMHWVRQAPGQGLEWMGYINPSRGYTNYNQKFKDRVTMTTDTSISTAYMELSRLRSDDTAVYYCARYYDDHYSLDYWGQGTLVTVSS

SEQ ID NO: 53 - protein, 106 aa, Artificial Sequence
  Synthetic Sequence
EIVLTQSPATLSLSPGERATLSCSASSSVSYMNWYQQKPGQAPRLLIYDTSKLASGVPAHFRGSGSGTDYTLTISSLEPEDFAVYYCQQWSSNPFTFGQGTKVEIK

SEQ ID NO: 54 - protein, 125 aa, Artificial Sequence
  Synthetic Sequence
EVQLVESGGGLVQPGGSLRLSCAASGFTFSTYAMNWVRQAPGKGLEWVGRIRSKYNNYATYYADSVKDRFTISRDDSKNSLYLQMNSLKTEDTAVYYCARHGNFGNSYVSWFAYWGQGTLVTVSS

SEQ ID NO: 55 - protein, 125 aa, Artificial Sequence
  Synthetic Sequence
EVQLVESGGGLVQPGGSLRLSCAASGFTFSTYAMNWVRQAPGKGLEWVGRIRSKYNNYATYYADSVKDRFTISRDDSKNSLYLQMNSLKTEDTAVYYCARHGNFGNSYVSYFAYWGQGTLVTVSS

SEQ ID NO: 56 - protein, 125 aa, Artificial Sequence
  Synthetic Sequence
EVQLVESGGGLVQPGGSLRLSCAASGFTFSTYAMNWVRQAPGKGLEWVGRIRSKYNNYATYYADSVKDRFTISRDDSKNSLYLQMNSLKTEDTAVYYCARHGNFGNSYVSHFAYWGQGTLVTVSS

SEQ ID NO: 57 - protein, 110 aa, Artificial Sequence
  Synthetic Sequence
DIQMTQSPSSLSASVGDRVTITCRSSTGAVTTSNYANWVQQKPGKAPKGLIGGTNKRAPGVPSRFSGSLIGDKATLTISSLQPEDFATYYCALWYSNLWVFGQGTKVEIK

SEQ ID NO: 58 - protein, 110 aa, Artificial Sequence
  Synthetic Sequence
DIQMTQSPSSLSASVGDRVTITCRSSTGAVTTSNYANWVQQKPGKAPKGLIGGTNKRAPGVPARFSGSGSGTDFTLTISSLQPEDFATYYCALWYSNLWVFGQGTKVEIK

SEQ ID NO: 59 - protein, 110 aa, Artificial Sequence
  Synthetic Sequence
DIQMTQSPSSLSASVGDRVTITCRSSTGAVTTSNYANWVQQKPGKAPKALIGGTNKRAPGVPSRFSGSLIGDKATLTISSLQPEDFATYYCALWYSNLWVFGQGTKVEIK

SEQ ID NO: 60 - protein, 244 aa, Artificial Sequence
  Synthetic Sequence
QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSGSTGGGGSGGGGSGGGGSDIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINR

SEQ ID NO: 61 - protein, 246 aa, Artificial Sequence
  Synthetic Sequence
QIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRGSTGGGGSGGGGSGGGGSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSS

SEQ ID NO: 62 - protein, 241 aa, Artificial Sequence
  Synthetic Sequence
MHEEEIYTSLQWDSPAPDTYQKCLSSNKCSGACCLVMVISCVFCMGLLTASIFLGVKLLQVSTIAMQQQEKLIQQERALLNFTEWKRSCALQMKYCQAFMQNSLSSAHNSSPCPNNWIQNRESCYYVSEIWSIWHTSQENCLKEGSTLLQIESKEEMDFITGSLRKIKGSYDYWVGLSQDGHSGRWLWQDGSSPSPGLLPAERSQSANQVCGYVKSNSLLSSNCSTWKYFICEKYALRSSV

SEQ ID NO: 63 - protein, 447 aa, Artificial Sequence
  Synthetic Sequence
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 64 - protein, 218 aa, Artificial Sequence
  Synthetic Sequence
EIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 65 - protein, 440 aa, Artificial Sequence
  Synthetic Sequence
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 66 - protein, 214 aa, Artificial Sequence
  Synthetic Sequence
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 67 - protein, 106 aa, Artificial Sequence
  Synthetic Sequence
EIVLTQSPSSLSASVGDRVTITCSARSSVSYMHWYQQKPGKAPKLLIYRTSNLASGVPSRFSGSGSGTDFTLTINSLQPEDFATYYCQQRSSFPLTFGGGTKLEIK

SEQ ID NO: 68 - protein, 106 aa, Artificial Sequence
  Synthetic Sequence
EIVLTQSPSSLSASVGDRVTITCSARSSVSYMHWFQQKPGKAPKLWIYRTSNLASGVPSRFSGSGSGTDYTLTINSLQPEDFATYYCQQRSSFPLTFGGGTKLEIK

SEQ ID NO: 69 - protein, 106 aa, Artificial Sequence
  Synthetic Sequence
EIVLTQSPSSLSASVGDRVTITCSARSSVSYMHWFQQKPGKAPKLWIYRTSNLASGVPSRFSGSGSGTDYCLTINSLQPEDFATYYCQQRSSFPLTFGGGTKLEIK

SEQ ID NO: 70 - protein, 106 aa, Artificial Sequence
  Synthetic Sequence
EIVLTQSPSSLSASVGDRVTITCSARSSVSYMHWFQQKPGKAPKLWIYRTSNLASGVPSRFSGSGSGTSYCLTINSLQPEDFATYYCQQRSSFPLTFGGGTKLEIK

SEQ ID NO: 71 - protein, 117 aa, Artificial Sequence
  Synthetic Sequence
QVQLVQSGSELKKPGASVKISCKASGYSFSNYGMNWVRQAPGQGLQWMGWINTDSGESTYAEEFKGRFVFSLDTSVSTAYLQITSLTAEDTGMYFCAKVGYDALDYWGQGTLVTVSS

SEQ ID NO: 72 - protein, 117 aa, Artificial Sequence
  Synthetic Sequence
QVQLVQSGSELKKPGASVKISCKASGYTFTNYGMNWVRQAPGQGLQWMGWINTDSGESTYAEEFKGRFVFSLDTSVSTAYLQITSLTAEDTGMYFCAKVGYDALDYWGQGTLVTVSS

SEQ ID NO: 73 - protein, 117 aa, Artificial Sequence
  Synthetic Sequence
QVQLVQSGSELKKPGASVKISCKASGYTFTNYGMNWVRQAPGQGLQWMGWINTDSGESTYAEEFKGRFVFSLDTSVNTAYLQITSLTAEDTGMYFCVRVGYDALDYWGQGTLVTVSS

SEQ ID NO: 74 - protein, 117 aa, Artificial Sequence
  Synthetic Sequence
QIQLVQSGSELKKPGASVKISCKASGYTFTNYGMNWVRQAPGQGLQWMGWINTDSGESTYAEEFKGRFVFSLDTSVNTAYLQITSLTAEDTGMYFCVRVGYDALDYWGQGTLVTVSS

SEQ ID NO: 75 - protein, 117 aa, Artificial Sequence
  Synthetic Sequence
QIQLVQSGSELKKPGASVKISCKASGYTFTNYGMNWVKQAPGQGLKWMGWINTDSGESTYAEEFKGRFAFSLDTSVNTAYLQITSLNAEDTGMYFCVRVGYDALDYWGQGTLVTVSS

SEQ ID NO: 76 - protein, 254 aa, Artificial Sequence
  Synthetic Sequence
LFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWLLHIFIPFCIIAFIFIATVIALRKQLCQKLYSSKDTTKRPVTTTKREVNSAI

SEQ ID NO: 77 - protein, 453 aa, Artificial Sequence
  Synthetic Sequence
MIFLLLMLSLELQLHQIAALFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 78 - protein, 29 aa, Artificial Sequence
  Synthetic Sequence
  MISC_FEATURE (8)..(8): A branch with sequence SNTSESF
SNTSESFKSNTSESFFRVTQLAPKAQIKE

SEQ ID NO: 79 - protein, 119 aa, Artificial Sequence
  Synthetic Sequence
EVQLQQSGPVLVKPGASVKMSCKASGYTFTDYYMNWVKQSHGKSLEWIGNINPYNGGTTYNQKFKGKATLTVDKSSRTAYMEINSLTSEDSAVYYCARGRIYDGSLDYWGQGTALTVSS

SEQ ID NO: 80 - protein, 106 aa, Artificial Sequence
  Synthetic Sequence
DIQMTQFPSSLCASQGGKVTVTCKASQDINNYMAWYQHKPGKGPRLLIHYTSTLLSGIPSRFSGSGSGRDYSFSISNLEPEDIATYYCLQYDNLWTFGGGTKLEIK

SEQ ID NO: 81 - protein, 116 aa, Artificial Sequence
  Synthetic Sequence
QVQLQQSGAELAKPGASVRLSCKASGYTFTNYWMHWVKQRPGQGLEWIGHINPSSGFTTYNQNFKDKATLTADKSSNTAYMQLSSLTYEDSAVYFCAREDYDVDYWGQGTTLTVSS

SEQ ID NO: 82 - protein, 107 aa, Artificial Sequence
  Synthetic Sequence
DIVMTQSQKFMSTSVGDRVSVTCKASQSVDTNVAWYQQKPGQSPKALIFSASYRYSGVPDRFTGSGSGTDFTLTINSVQSEDLAEYFCQQYNSYPYTFGSGTKLEIK

SEQ ID NO: 83 - protein, 122 aa, Artificial Sequence
  Synthetic Sequence
EVQLVESGGGLVKPGGSLKLSCAASGFTFSDYGMHWVRQAPEKGLEWVAYISSGSYTIYYTDTVKGRFTISRDNAKNTLFLQMTSLRSEDTAMYYCARRGYGSFYEYYFDYWGQGTTLTVSS

SEQ ID NO: 84 - protein, 106 aa, Artificial Sequence
  Synthetic Sequence
QIVLTQSPALMSASPGEKVTMTCSASSSVSYMYWYQQKPRSSPKPWIYLTSNLASGVPARFSGSGSGTSYSLTISSMEAEDAATYYCQQWSSNPFTFGSGTKLEIK

SEQ ID NO: 85 - protein, 119 aa, Artificial Sequence
  Synthetic Sequence
EVQLVESGGGLVQAGKSLRLSCAASGSIFSIHAMGWFRQAPGKEREFVAAITWSGGITYYEDSVKGRFTISRDNAKNTVYLQMNSLKPEDTAIYYCAADRAESSWYDYWGQGTQVTVSS

SEQ ID NO: 86 - protein, 119 aa, Artificial Sequence
  Synthetic Sequence
EVQLVESGGGLVQAGGSLRLSCAASGSIASIHAMGWFRQAPGKEREFVAVITWSGGITYYADSVKGRFTISRDNAKNTVYLQMNSLKPEDTAIYYCAGDKHQSSWYDYWGQGTQVTVSS

SEQ ID NO: 87 - protein, 119 aa, Artificial Sequence
  Synthetic Sequence
EVQLVESGGGLVQAGGSLRLSCAASGSISSIHAMGWFRQAPGKEREFVAAITWSGGITYYADSLKGRFTISRDNAKNTGYLQMNSLKPEDTAIYYCAADRAQSSWYDYWGQGTQVTVSS

SEQ ID NO: 88 - protein, 119 aa, Artificial Sequence
  Synthetic Sequence
EVQLVESGGGLVQAGGSLGLSCAASGSIFSINAMAWFRQAPGKEREFVALISWSGGSTYYEDSVKGRFTISRDNAKNTVYLQMNSLKPEDTAIYYCAADRVDSNWYDYWGQGTQVTVSS

SEQ ID NO: 89 - protein, 120 aa, Artificial Sequence
  Synthetic Sequence
EVQLVESGGGLVQAGGSLRLSCAASGRAFSSGTMGWFRRAPGKEREFVASIPWSGGRIYYADSVKGRFTISRDNAQNTVYLQMNSLKPEDTAVYYCAVKERSTGWDFASWGQCTQVTVSS

SEQ ID NO: 90 - protein, 121 aa, Artificial Sequence
  Synthetic Sequence
QVQLVQSGAELKQPGASVKMSCKASGYSFTSSWIHWVKQAPGQGLEWIGYIYPSTGFTEYNQKFKDRATLTADKSTSTAYMELSSLRSEDSAVYYCARWRDSSGYHAMDYWGQGTSVTVSS

SEQ ID NO: 91 - protein, 122 aa, Artificial Sequence
  Synthetic Sequence
QVQLVQSGAEVKQPGASVKMSCKASGYSFTSSWIHWVKQAPGQGLEWIGYIYPSTGFTEYNQKFKDRATLTADKSTSTAYMELSSLRSEDTAVYYDCARWRDSSGYHAMDYWGQGTSVTVSS

SEQ ID NO: 92 - protein, 121 aa, Artificial Sequence
  Synthetic Sequence
QVQLVQSGHEVKQPGASVKMSCKASGYSFTSSWIHWVKQAPGQGLEWIGYIYPSTGFTEYNQKFKDRATLTADKSTSTAYMELSSLRSEDTAVYYCARWRDSSGYHAMDYWGQGTLVTVSS

SEQ ID NO: 93 - protein, 121 aa, Artificial Sequence
  Synthetic Sequence
QVQLVQSGHEVKQPGASVKMSCKASGYSFTSSWIHWVRQAPGQGLEWIGYIYPSTGFTEYNQKFKDRATLTADKSTSTAYMELSSLRSEDTAVYYCARWRDSSGYHAMDYWGQGTLVTVSS

SEQ ID NO: 94 - protein, 121 aa, Artificial Sequence
  Synthetic Sequence
QVQLVQSGHEVKQPGASVKVSCKASGYSFTSSWIHWVRQAPGQGLEWIGYIYPSTGFTEYNQKFKDRATITADKSTSTAYMELSSLRSEDTAVYYCARWRDSSGYHAMDYWGQGTLVTVSS

SEQ ID NO: 95 - protein, 111 aa, Artificial Sequence
  Synthetic Sequence
DIVLTQSPASLTLSPGQRLTISCRASQSVSTSGYSYMHWYQQKPDQSPKLLIKFGSNLESGIPARFSGSGSGTDFTLTISSLEEEDFATYYCQHSWEIPYTFGQGTKLEIK

SEQ ID NO: 96 - protein, 111 aa, Artificial Sequence
  Synthetic Sequence
DIVLTQSPATLSLSPGQRLTISCRASQSVSTSGYSYMHWYQQKPDQSPKLLIKFGSNLESGIPARFSGSGSGTDFTLTISSLEPEDFATYYCQHSWEIPYTFGQGTKLEIK

SEQ ID NO: 97 - protein, 111 aa, Artificial Sequence
  Synthetic Sequence
EIVLTQSPATLSLSPGQRLTISCRASQSVSTSGYSYMHWYQQKPDQSPKLLIKFGSNLESGIPARFSGSGSGTDFTLTISSLEPEDFATYYCQHSWEIPYTFGQGTKLEIK

SEQ ID NO: 98 - protein, 111 aa, Artificial Sequence
  Synthetic Sequence
DIVLTQSPATLSLSPGQRLTISCRASQSVSTSGYSYMHWYQQKPDQSPKLLIKFGSNLESGIPARFSGSGSGTDFTLTISSLEPEDFAVYYCQHSWEIPYTFGQGTKLEIK

SEQ ID NO: 99 - protein, 451 aa, Artificial Sequence
  Synthetic Sequence
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 100 - protein, 215 aa, Artificial Sequence
  Synthetic Sequence
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 101 - protein, 121 aa, Artificial Sequence
  Synthetic Sequence
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSS

SEQ ID NO: 102 - protein, 108 aa, Artificial Sequence
  Synthetic Sequence
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTKVEIK

SEQ ID NO: 103 - protein, 448 aa, Artificial Sequence
  Synthetic Sequence
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 104 - protein, 214 aa, Artificial Sequence
  Synthetic Sequence
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 105 - protein, 450 aa, Artificial Sequence
  Synthetic Sequence
EVQLLESGGGLVQPGGSLRLSCAASGFTFSSYIMMWVRQAPGKGLEWVSSIYPSGGITFYADTVKGRFTISRDNSKNTLYLQMNSLRAEDTAVYYCARIKLGTVTTVDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 106 - protein, 216 aa, Artificial Sequence
  Synthetic Sequence
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 107 - protein, 123 aa, Artificial Sequence
  Synthetic Sequence
QVQLVQSGAEVKKPGSSVKVSCKTSGDTFSTYAISWVRQAPGQGLEWMGGIIPIFGKAHYAQKFQGRVTITADESTSTAYMELSSLRSEDTAVYFCARKFHFVSGSPFGMDVWGQGTTVTVSS

SEQ ID NO: 108 - protein, 106 aa, Artificial Sequence
  Synthetic Sequence
EIVLTQSPATLSLSPGERATLSCRASQSVSSYLAWYQQKPGQAPRLLIYDASNRATGIPARFSGSGSGTDFTLTISSLEPEDFAVYYCQQRSNWPTFGQGTKVEIK

SEQ ID NO: 109 - protein, 117 aa, Artificial Sequence
  Synthetic Sequence
QVQLVQSGAEVKKPGASVKVSCKASGYTFTDYGFSWVRQAPGQGLEWMGWITAYNGNTNYAQKLQGRVTMTTDTSTSTVYMELRSLRSDDTAVYYCARDYFYGMDVWGQGTTVTVSS

SEQ ID NO: 110 - protein, 107 aa, Artificial Sequence
  Synthetic Sequence
EIVLTQSPATLSLSPGERATLSCRASQSVSSYLVWYQQKPGQAPRLLIYDASNRATGIPARFSGSGSGTDFTLTISSLEPEDFAVYYCQQRSNWPRTFGQGTKVEIK

SEQ ID NO: 111 - protein, 118 aa, Artificial Sequence
  Synthetic Sequence
QVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSS

SEQ ID NO: 112 - protein, 107 aa, Artificial Sequence
  Synthetic Sequence
DIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIK

SEQ ID NO: 113 - protein, 120 aa, Artificial Sequence
  Synthetic Sequence
QVQLVQSGAEVKKPGSSVKVSCKVSGGIFSTYAINWVRQAPGQGLEWMGGIIPIFGTANHAQKFQGRVTITADESTSTAYMELSSLRSEDTAVYYCARDQGIAAALFDYWGQGTLVTVSS

SEQ ID NO: 114 - protein, 108 aa, Artificial Sequence
  Synthetic Sequence
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 115 - protein, 113 aa, Artificial Sequence
  Synthetic Sequence
EVQLVESGGGLVQPGRSLRLSCAVSGFTFDDYVVHWVRQAPGKGLEWVSGISGNSGNIGYADSVKGRFTISRDNAKNSLYLQMNSLRAEDTALYYCAVPFDYWGQGTLVTVSS

SEQ ID NO: 116 - protein, 123 aa, Artificial Sequence
  Synthetic Sequence
QVQLVQSGAEVKKPGSSVKVSCKTSGDTFSSYAISWVRQAPGQGLEWMGGIIPIFGRAHYAQKFQGRVTITADESTSTAYMELSSLRSEDTAVYFCARKFHFVSGSPFGMDVWGQGTTVTVSS

SEQ ID NO: 117 - protein, 123 aa, Artificial Sequence
  Synthetic Sequence
QVQLVQSGAEVKKPGSSVKVSCKTSGGTFSSYAISWVRQAPGQGLEWMGGIIPIFGKAHYAQKFQGRVTITADESTTTAYMELSSLRSEDTAVYYCARKYDYVSGSPFGMDVWGQGTTVTVSS

SEQ ID NO: 118 - protein, 121 aa, Artificial Sequence
  Synthetic Sequence
QVQLVQSGAEVKKPGSSVKVSCKASGGTFSSYAINWVRQAPGQGLEWMGGIIPIFGSANYAQKFQDRVTITADESTSAAYMELSSLRSEDTAVYYCARDSSGWSRYYMDVWGQGTTVTVSS

SEQ ID NO: 119 - protein, 106 aa, Artificial Sequence
  Synthetic Sequence
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFGGGTKVEIK

SEQ ID NO: 120 - protein, 123 aa, Artificial Sequence
  Synthetic Sequence
QVQLVQSGAEVKEPGSSVKVSCKASGGTFNSYAISWVRQAPGQGLEWMGGIIPLFGIAHYAQKFQGRVTITADESTNTAYMDLSSLRSEDTAVYYCARKYSYVSGSPFGMDVWGQGTTVTVSS

SEQ ID NO: 121 - protein, 106 aa, Artificial Sequence
  Synthetic Sequence
EIVLTQSPATLSLSPGERATLSCRASQSVSSYLAWYQQKPGQAPRLLIYDASNRATGIPARFSGSGSGTDFTLTISSLEPEDFAVYYCQQRSNWPTFGQGTRLEIK

SEQ ID NO: 122 - protein, 121 aa, Artificial Sequence
  Synthetic Sequence
EVQLVESGGGLVQPGRSLRLSCAASGITFDDYGMHWVRQAPGKGLEWVSGISWNRGRIEYADSVKGRFTISRDNAKNSLYLQMNSLRAEDTALYYCAKGRFRYFDWFLDYWGQGTLVTVSS

SEQ ID NO: 123 - protein, 107 aa, Artificial Sequence
  Synthetic Sequence
AIQLTQSPSSLSASVGDRVTITCRASQGISSALAWYQQKPGKAPKLLIYDASSLESGVPSRFSGSGSGTDFTLTISSLQPEDFATYYCQQFNSYPFTFGPGTKVDIK

SEQ ID NO: 124 - protein, 118 aa, Artificial Sequence
  Synthetic Sequence
EVKLQESGPSLVKPSQTLSLTCSVTGYSITSDYWNWIRKFPGNKLEYVGYISYTGSTYYNPSLKSRISITRDTSKNQYYLQLNSVTSEDTATYYCARYGGWLSPFDYWGQGTTLTVSS

SEQ ID NO: 125 - protein, 107 aa, Artificial Sequence
  Synthetic Sequence
DIVMTQSHKLMSTSVGDRVSITCKASQDVGTAVAWYQQKPGQSPKLLIYWASTRHTGVPDRFTGSGSGTDFTLTISNVQSEDLADYFCQQDSSYPLTFGAGTKVELK

SEQ ID NO: 126 - protein, 120 aa, Artificial Sequence
  Synthetic Sequence
EVQLQESGPGLVAPSQSLSITCTVSGFSLTTYSINWIRQPPGKGLEWLGVMWAGGGTNSNSVLKSRLIISKDNSKSQVFLKMNSLQTDDTARYYCARYYGNSPYYAIDYWGQGTSVTVSS

SEQ ID NO: 127 - protein, 107 aa, Artificial Sequence
  Synthetic Sequence
DIVTTQSHKLMSTSVGDRVSITCKASQDVGTAVAWYQQKPGQSPKLLIYWASTRHTGVPDRFTGSGSGTDFTLTISNVQSEDLADYFCQQDSSYPLTFGAGTKVELK

SEQ ID NO: 128 - protein, 118 aa, Artificial Sequence
  Synthetic Sequence
EVKLQESGPSLVKPSQTLSLTCSVTGYSIISDYWNWIRKFPGNKLEYLGYISYTGSTYYNPSLKSRISITRDTSKNQYYLQLNSVTTEDTATYYCARRGGWLLPFDYWGQGTTLTVSS

SEQ ID NO: 129 - protein, 113 aa, Artificial Sequence
  Synthetic Sequence
DIVMTQSPSSLAVSVGEKVSMGCKSSQSLLYSSNQKNSLAWYQQKPGQSPKLLIDWASTRESGVPDRFTGSGSGTDFTLTISSVKAEDLAVYYCQQYYGYPLTFGAGTKLELK

SEQ ID NO: 130 - protein, 118 aa, Artificial Sequence
  Synthetic Sequence
EVKLQESGPSLVKPGASVKLSCKASGYTFTSYDINWVKQRPGQGLEWIGWIFPRDNNTKYNENFKGKATLTVDTSSTTAYMELHSLTSEDSAVYFCTKENWVGDFDYWGQGTTLTLSS

SEQ ID NO: 131 - protein, 106 aa, Artificial Sequence
  Synthetic Sequence
DIVMTQSPAIMSASPGEKVTMTCSASSSIRYMHWYQQKPGTSPKRWISDTSKLTSGVPARFSGSGSGTSYALTISSMEAEDAATYYCHQRSSYPWTFGGGTKLEIK

SEQ ID NO: 132 - protein, 114 aa, Artificial Sequence
  Synthetic Sequence
EVQLQQSGPDLVTPGASVRISCQASGYTFPDYYMNWVKQSHGKSLEWIGDIDPNYGGTTYNQKFKGKAILTVDRSSSTAYMELRSLTSEDSAVYYCARGALTDWGQGTSLTVSS

SEQ ID NO: 133 - protein, 106 aa, Artificial Sequence
  Synthetic Sequence
QIVLSQSPAILSASPGEKVTMTCRASSSVSYIYWFQQKPGSSPKPWIYATFNLASGVPARFSGSGSGTSYSLTISRVETEDAATYYCQQWSNNPLTFGAGTKLELK

SEQ ID NO: 134 - protein, 115 aa, Artificial Sequence
  Synthetic Sequence
EVQLVQSGPELKKPGASVKMSCKASGYTFTSYVMHWVKQAPGQRLEWIGYVNPFNDGTKYNEMFKGRATLTSDKSTSTAYMELSSLRSEDSAVYYCARQAWGYPWGQGTLVTVSS

SEQ ID NO: 135 - protein, 115 aa, Artificial Sequence
  Synthetic Sequence
EVQLVQSGAEVKKPGASVKMSCKASGYTFTSYVMHWVKQAPGQRLEWIGYVNPFNDGTKYNEMFKGRATLTSDKSTSTAYMELSSLRSEDTAVYYCARQAWGYPWGQGTLVTVSS

SEQ ID NO: 136 - protein, 115 aa, Artificial Sequence
  Synthetic Sequence
EVQLVQSGAEVKKPGASVKMSCKASGYTFTSYVMHWVRQAPGQRLEWIGYVNPFNDGTKYNEMFKGRATLTSDKSTSTAYMELSSLRSEDTAVYYCARQAWGYPWGQGTLVTVSS

SEQ ID NO: 137 - protein, 115 aa, Artificial Sequence
  Synthetic Sequence
EVQLVQSGAEVKKPGASVKVSCKASGYTFTSYVMHWVRQAPGQRLEWIGYVNPFNDGTKYNEMFKGRATLTSDKSTSTAYMELSSLRSEDTAVYYCARQAWGYPWGQGTLVTVSS

SEQ ID NO: 138 - protein, 115 aa, Artificial Sequence
  Synthetic Sequence
EVQLVQSGAEVKKPGASVKVSCKASGYTFTSYVMHWVRQAPGQRLEWIGYVNPFNDGTKYNEMFKGRATITSDKSTSTAYMELSSLRSEDTAVYYCARQAWGYPWGQGTLVTVSS

SEQ ID NO: 139 - protein, 111 aa, Artificial Sequence
  Synthetic Sequence
DIVLTQSPASLALSPGERATLSCRATESVEYYGTSLVQWYQQKPGQPPKLLIYAASSVDSGVPSRFSGSGSGTDFTLTINSLEEEDAAMYFCQQSRRVPYTFGQGTKLEIK

SEQ ID NO: 140 - protein, 111 aa, Artificial Sequence
  Synthetic Sequence
DIVLTQSPATLSLSPGERATLSCRATESVEYYGTSLVQWYQQKPGQPPKLLIYAASSVDSGVPSRFSGSGSGTDFTLTINSLEAEDAAMYFCQQSRRVPYTFGQGTKLEIK

SEQ ID NO: 141 - protein, 111 aa, Artificial Sequence
  Synthetic Sequence
EIVLTQSPATLSLSPGERATLSCRATESVEYYGTSLVQWYQQKPGQPPKLLIYAASSVDSGVPSRFSGSGSGTDFTLTINSLEAEDAAMYFCQQSRRVPYTFGQGTKLEIK

SEQ ID NO: 142 - protein, 111 aa, Artificial Sequence
  Synthetic Sequence
DIVLTQSPATLSLSPGERATLSCRATESVEYYGTSLVQWYQQKPGQPPKLLIYAASSVDSGVPSRFSGSGSGTDFTLTINSLEAEDAATYFCQQSRRVPYTFGQGTKLEIK

SEQ ID NO: 143 - protein, 120 aa, Artificial Sequence
  Synthetic Sequence
EVQLVESGGGLVKPGGSLRLSCAASGFTFSTYSMNWVRQAPGKGLEWVSSISSSGDYIYYADSVKGRFTISRDNAKNSLFLQMNSLKAEDTAVYYCARDLVTSMVAFDYWGQGTLVTVSS

SEQ ID NO: 144 - protein, 108 aa, Artificial Sequence
  Synthetic Sequence
SYELTQPPSVSVSPGQAARITCSGDALPQKYVFWYQQKSGQAPVLVIYEDSKRPSGIPERFSGSSSGTMATLTISGAQVEDEADYYCYSTDRSGNHRVFGGGTRLTVL

SEQ ID NO: 145 - protein, 120 aa, Artificial Sequence
  Synthetic Sequence
EVQLVESGGGLVQPGGSLRLSCAASGFTFSSYWMSWVRQAPGKGLEWVANIKQDGGEQYYVDSVKGRFTISRDNAKNSLYLQMNSLRAEDTAVYYCARDWNYGYYDMDVWGQGTTVTVSS

SEQ ID NO: 146 - protein, 108 aa, Artificial Sequence
  Synthetic Sequence
EIVLTQSPGTLSLSPGERATLSCRASQSVSSNYLAWFQQKPGQAPRLLIFGTSSRATGIPDRFSGSGSGTDFTLTISRLEPEDFAVYYCQQYGSSIFTFGPGTKVDIK

SEQ ID NO: 147 - protein, 108 aa, Artificial Sequence
  Synthetic Sequence
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTEVEIK

SEQ ID NO: 148 - protein, 121 aa, Artificial Sequence
  Synthetic Sequence
EVQLLESGGGLVQPGGSLRLSCAASGFTFSNYAMSWVRQAPGKGLEWVSAIRGSGGSTYYADSVKGRFTISRDNSKNTLYLQMNSLRAEDTAVYYCAKDLHYDSSGYLDYWGQGTLVTVSS

SEQ ID NO: 149 - protein, 107 aa, Artificial Sequence
  Synthetic Sequence
DIQMTQSPSSVSASVGDRVTITCRASQGIRSWLAWYQQKPGKAPKLLIYAISRLQSGVPSRFSGSGSGTDFTLTISSLQPEDFATYYCQQANSFPLTFGGGTKVEIK

SEQ ID NO: 150 - protein, 107 aa, Artificial Sequence
  Synthetic Sequence
DIQMTQSPSSVSASVGDRVTITCRASQGISSWLAWYQQKSGKAPKLLIYAASGLQSGVPSRFSGSGSGTDFTLTISSLQPEDLATYYCQQSHSLPPTFGQGTKVEIK

SEQ ID NO: 151 - protein, 121 aa, Artificial Sequence
  Synthetic Sequence
EVQLLESGGDLVQPGGSLRLSCAASGFTFNSYAMSWVRQAPGKGLEWVSTISGSGGFTFSADSVKGRFTISRDNSKNTLFLQMNSLRVEDSAVYSCAKVLVGFNNGCWDYWGQGTLVTVSS

SEQ ID NO: 152 - protein, 108 aa, Artificial Sequence
  Synthetic Sequence
SYVLTQPPSVSVAPGQTARITCGGNNIGSKSVHWYQQKPGQAPVLVVYDDSDRPSGIPERFSGSNSGNTATLTISRVEAGDEADYYCQVWDSSNDHVVFGGGTKLTVL

SEQ ID NO: 153 - protein, 120 aa, Artificial Sequence
  Synthetic Sequence
EVQLVESGGGLVKPGGSLRLSCAASGFTFSTYSMNWVRQAPGKGLEWVSSISSSGDYIYYADSVKGRFTISRDNAKNSLYLQMNSLRAEDTAVYYCARDLVTSMVAFDYWGQGTLVTVSS

SEQ ID NO: 154 - protein, 108 aa, Artificial Sequence
  Synthetic Sequence
SYELTQPPSVSVSPGQTARITCSGDALPQKYVFWYQQKSGQAPVLVIYEDSKRPSGIPERFSGSSSGTMATLTISGAQVEDEADYYCYSTDRSGNHRVFGGGTKLTVL

SEQ ID NO: 155 - protein, 120 aa, Artificial Sequence
  Synthetic Sequence
QVQLVQSGAEVKKPGASVKVSCKASGYTFTSYWMYWVRQATGQGLEWMGRIDPNSGSTKYNEKFKNRFTISRDDSKNTAYLQMNSLKTEDTAVYYCARDYRKGLYAMDYWGQGTTVTVSS

SEQ ID NO: 156 - protein, 120 aa, Artificial Sequence
  Synthetic Sequence
EVQLVQSGAEVKKPGATVKISCKVSGYTFTSYWMYWVRQATGQGLEWMGRIDPNSGSTKYNEKFKNRVTITADKSTSTAYMELSSLRSEDTAVYYCARDYRKGLYAMDYWGQGTTVTVSS

SEQ ID NO: 157 - protein, 120 aa, Artificial Sequence
  Synthetic Sequence
EVQLVQSGAEVKKPGESLRISCKGSGYTFTSYWMYWVRQAPGQGLEWMGRIDPNSGSTKYNEKFKNRVTISVDTSKNQFSLKLSSVTAADTAVYYCARDYRKGLYAMDYWGQGTTVTVSS

SEQ ID NO: 158 - protein, 120 aa, Artificial Sequence
  Synthetic Sequence
EVQLVQSGAEVKKPGATVKISCKVSGYTFTSYWMYWIRQSPSRGLEWLGRIDPNSGSTKYNEKFKNRLTISKDTSKNQVVLTMTNMDPVDTATYYCARDYRKGLYAMDYWGQGTTVTVSS

SEQ ID NO: 159 - protein, 120 aa, Artificial Sequence
  Synthetic Sequence
EVQLVQSGAEVKKPGESLRISCKGSGYTFTSYWMYWIRQPPGKGLEWIGRIDPNSGSTKYNEKFKNRVTITADKSTSTAYMELSSLRSEDTAVYYCARDYRKGLYAMDYWGQGTTVTVSS

SEQ ID NO: 160 - protein, 120 aa, Artificial Sequence
  Synthetic Sequence
QVQLVQSGAEVKKPGASVKVSCKASGYTFTSYWMYWIRQSPSRGLEWLGRIDPNSGSTKYNEKFKNRFTISRDDSKNTAYLQMNSLKTEDTAVYYCARDYRKGLYAMDYWGQGTTVTVSS

SEQ ID NO: 161 - protein, 120 aa, Artificial Sequence
  Synthetic Sequence
EVQLVQSGAEVKKPGESLRISCKGSGYTFTSYWMYWVRQARGQRLEWIGRIDPNSGSTKYNEKFKNRLTISKDTSKNQVVLTMTNMDPVDTATYYCARDYRKGLYAMDYWGQGTTVTVSS

SEQ ID NO: 162 - protein, 120 aa, Artificial Sequence
  Synthetic Sequence
QITLKESGPTLVKPTQTLTLTCTFSGYTFTSYWMYWVRQAPGKGLEWVSRIDPNSGSTKYNEKFKNRVTITADKSTSTAYMELSSLRSEDTAVYYCARDYRKGLYAMDYWGQGTTVTVSS

SEQ ID NO: 163 - protein, 120 aa, Artificial Sequence
  Synthetic Sequence
EVQLVQSGAEVKKPGATVKISCKVSGYTFTSYWMYWVRQARGQRLEWIGRIDPNSGSTKYNEKFKNRFTISRDNSKNTLYLQMNSLRAEDTAVYYCARDYRKGLYAMDYWGQGTTVTVSS

SEQ ID NO: 164 - protein, 107 aa, Artificial Sequence
  Synthetic Sequence
DIVMTQTPLSLPVTPGEPASISCKASQDVGTAVAWYLQKPGQSPQLLIYWASTRHTGIPARFSGSGSGTEFTLTISSLQSEDFAVYYCQQYNSYPLTFGQGTKVEIK

SEQ ID NO: 165 - protein, 107 aa, Artificial Sequence
  Synthetic Sequence
DIQMTQSPSSLSASVGDRVTITCKASQDVGTAVAWYLQKPGQSPQLLIYWASTRHTGVPSRFSGSGSGTDFTLTISSLQPEDFATYYCQQYNSYPLTFGQGTKVEIK

SEQ ID NO: 166 - protein, 107 aa, Artificial Sequence
  Synthetic Sequence
EIVLTQSPDFQSVTPKEKVTITCKASQDVGTAVAWYLQKPGQSPQLLIYWASTRHTGVPDRFSGSGSGTDFTLKISRVEAEDVGVYYCQQYNSYPLTFGQGTKVEIK

SEQ ID NO: 167 - protein, 107 aa, Artificial Sequence
  Synthetic Sequence
EIVLTQSPDFQSVTPKEKVTITCKASQDVGTAVAWYLQKPGQSPQLLIYWASTRHTGVPSRFSGSGSGTDFTFTISSLQPEDIATYYCQQYNSYPLTFGQGTKVEIK

SEQ ID NO: 168 - protein, 107 aa, Artificial Sequence
  Synthetic Sequence
EIVLTQSPATLSLSPGERATLSCKASQDVGTAVAWYLQKPGQSPQLLIYWASTRHTGIPPRFSGSGYGTDFTLTINNIESEDAAYYFCQQYNSYPLTFGQGTKVEIK

SEQ ID NO: 169 - protein, 107 aa, Artificial Sequence
  Synthetic Sequence
DVVMTQSPLSLPVTLGQPASISCKASQDVGTAVAWYQQKPGQAPRLLIYWASTRHTGVPSRFSGSGSGTEFTLTISSLQPDDFATYYCQQYNSYPLTFGQGTKVEIK

SEQ ID NO: 170 - protein, 107 aa, Artificial Sequence
  Synthetic Sequence
DIQMTQSPSSLSASVGDRVTITCKASQDVGTAVAWYQQKPGQAPRLLIYWASTRHTGVPSRFSGSGSGTDFTFTISSLQPEDIATYYCQQYNSYPLTFGQGTKVEIK

SEQ ID NO: 171 - protein, 107 aa, Artificial Sequence
  Synthetic Sequence
AIQLTQSPSSLSASVGDRVTITCKASQDVGTAVAWYLQKPGQSPQLLIYWASTRHTGVPSRFSGSGSGTDFTFTISSLEAEDAATYYCQQYNSYPLTFGQGTKVEIK

SEQ ID NO: 172 - protein, 107 aa, Artificial Sequence
  Synthetic Sequence
EIVLTQSPDFQSVTPKEKVTITCKASQDVGTAVAWYQQKPGQAPRLLIYWASTRHTGVPSRFSGSGSGTEFTLTISSLQPDDFATYYCQQYNSYPLTFGQGTKVEIK

SEQ ID NO: 173 - protein, 116 aa, Artificial Sequence
  Synthetic Sequence
EVKLVESGGGLVKPGGSLKLSCAASGFIFRSYGMSWVRQTPEKRLEWVASISSGGSTYYPDSVKGRFTISRDNARNILYLQMSSLRSEDTAMYDCARGYDSGFAYWGQGTLVTVSE

SEQ ID NO: 174 - protein, 116 aa, Artificial Sequence
  Synthetic Sequence
EVKLVESGGGLVKPGGSLKLSCAASGFTFRSYGMSWVRQTPEKRLEWVASISSGGTTYYPDSVKGRFIISRDNARNILYLQMSSLRSEDTAMYYCAKGYDSGFAYWGQGTLVIVSA

SEQ ID NO: 175 - protein, 116 aa, Artificial Sequence
  Synthetic Sequence
QVQLKQSGPGLVQPSQSLSITCTVSGFSLTTYGVHWVRQSPGKGLEWLGVIWRGVTTDYNAAFMSRLTITKDNSKSQVFFKMNSLQANDTAIYYCARLGFYAMDYWGQGTSVTVSS

SEQ ID NO: 176 - protein, 116 aa, Artificial Sequence
  Synthetic Sequence
QVQLKQSGPGLVQPSQSLSITCTVSGFSLTSYGVHWVRQSPGKGLEWLGVIWSGGVTDYNAAFISRLSISKDNSKSQVFFKMNSLQANDTAIYYCARLGFYAMDYWGQGTSVTVSS

SEQ ID NO: 177 - protein, 119 aa, Artificial Sequence
  Synthetic Sequence
EVKLFESGGGLVQPGGSLKLSCVASGFDFSTYWMHWVRQAPGQGLEWIGQINPDSTTINYAPSLKDRFIISRDNAKNTLFLQMSKVRSEDTALYYCAKPGDYGYDFDCWGQGTTLTVSS

SEQ ID NO: 178 - protein, 119 aa, Artificial Sequence
  Synthetic Sequence
EVQLQESGPSLVKPSQTLSLTCSVTGDSITSGYWNWIRKFPGNKLEYMGYISYSGSTYYNPSLKSRISITRDTSKNQYYLQLNSVTTEDTATYYCARSLLWFSTGFAYWGQGTLVTVSA

SEQ ID NO: 179 - protein, 116 aa, Artificial Sequence
  Synthetic Sequence
QVQLKQSGPGLVQPSQSLSITCTVSGFSLTSYGVHWVRQSPGKGLEWLGVIWSGGITDYNAAFKSRLSISKDNSKSQVFFKMNSLQANDTAIYFCARLGFYAMDYWGQGTSVTVSS

SEQ ID NO: 180 - protein, 116 aa, Artificial Sequence
  Synthetic Sequence
EVKLVESGGGLVKPGGSLKLSCAASGFTFRSYGMSWARQIPEKRLEWVASISSGGTTYYLGSVQGRFTISRDNARNILYLQMSSLRSEDTAMYYCARGYDAGFAYWGQGTLVSVSE

SEQ ID NO: 181 - protein, 117 aa, Artificial Sequence
  Synthetic Sequence
EVQLQESGPSLVKPSQTLSLTCSVTGDSITSGYWTWIRKFPGNKLEYMGYISYTGSTYYNPSLKSRISISRDTSKSQYYLQLNSVTTEDTATYYCARQRDWLGFAYWGQGTLVTVSA

SEQ ID NO: 182 - protein, 116 aa, Artificial Sequence
  Synthetic Sequence
EEKLVESGGGLVKPGGSLKLSCAASGFSFSSYGMSWVRQTPEKRLEWVASISSGGSIYYPDSVKGRFTISRDNARNILYLQMSSLRSEDTAMYYCARGYDAGFAFWGQGTLVTASA

SEQ ID NO: 183 - protein, 116 aa, Artificial Sequence
  Synthetic Sequence
QITLKESGPTLVKPTQTLTLTCTVSGFSLSTYGVHWIRQPPGKALEWLGVIWRGVTTDYNAAFMSRLTITKDNSKNQVVLTMNNMDPVDTATYYCARLGFYAMDYWGQGTLVTVSS

SEQ ID NO: 184 - protein, 116 aa, Artificial Sequence
  Synthetic Sequence
EVQLVESGGGLVKPGGSLRLSCAASGFIFRSYGMSWVRQAPGKGLEWVASISSGGSTYYPDSVKGRFTISRDNAKNSLYLQMNSLRAEDTAVYDCARGYDSGFAYWGQGTLVTVSS

SEQ ID NO: 185 - protein, 112 aa, Artificial Sequence
  Synthetic Sequence
DIVLTQSPASLAVSLGQRATISCRASQSVSTSSSSFMHWYQQKPGQPPKLLIKYASNLESGVPARFSGSGSGTDFTLNIHPVEEEDTATYYCQHSWEIPYTFGGGTKLEIKR

SEQ ID NO: 186 - protein, 111 aa, Artificial Sequence
  Synthetic Sequence
DIVLTQSPPSLAVSLGQRATISCRASQSVSTSSSSYMHWYQQKPGQPPKLLIKYASNLESGVPARFSGSGSGTDFTLNIHPVEEEDTATYYCQHSWEIPYTFGGGTKLEIK

SEQ ID NO: 187 - protein, 107 aa, Artificial Sequence
  Synthetic Sequence
SIVMTQTPKFLLVSAGDRVTITCKASQSVSNDVAWYQQKPGQSPKLLIYYAANRYTGVPDRFTGSGYGTDFTFTISIVQAEDLAVYFCQQDYTSPYTFGGGTKLEIK

SEQ ID NO: 188 - protein, 107 aa, Artificial Sequence
  Synthetic Sequence
SIVMTQTPKFLLVSAGDRVTITCKASQSVSNDVGWYQQKPGQSPKLLIYYASNRYSGVPDRFTGSGYGTDFTFTISTVQAEDLAVYFCQQDYTSPYTFGGGTKLEIK

SEQ ID NO: 189 - protein, 112 aa, Artificial Sequence
  Synthetic Sequence
DVLMTQTPLYLPVSLGDQASISCRSSQIIVHSNANTYLEWFLQKPGQSPKLLIYKVSNRFSGVPDRFSGSGSGTDFTLKISRVEAEDLGVYYCFQGSHVPYTFGGGTKLEIK

SEQ ID NO: 190 - protein, 108 aa, Artificial Sequence
  Synthetic Sequence
QIVLTQSPAIMSASPGEKVTLTCSASSSVSSSYLYWNQQKPGSSPKVWIYNTSNLASGVPARFSGSGSGTSYSLTISSMEAEDAASYFCHQWRSYPPTLGAGTKLELK

SEQ ID NO: 191 - protein, 106 aa, Artificial Sequence
  Synthetic Sequence
QIVLTQSPAIMSASPGEKVTMTCSANSSVSYMHWYQQKSGTSPKRWIYDTSKLASGVPARFSGSGSGTSYSLTISSMGAEDAATYYCQQWSSNPWTFGGGTKLEIK

SEQ ID NO: 192 - protein, 111 aa, Artificial Sequence
  Synthetic Sequence
DIVLTQSPASLAVSLGQRATISCRASQSVSTSSYSYMHWYQQKPGQPPKLLIKYASNLESGVPARFSGSGSGTDFTLNIHPVEEEDTATYYCQNSWEIPYTFGGGTKLEIK

SEQ ID NO: 193 - protein, 113 aa, Artificial Sequence
  Synthetic Sequence
DIVMTQTPSSLAVSLGEKVTMSCKSSQSLLYSSNQKNSLAWYQQKPGQSPKLLIYWASNRESGVPDRFTGSSSGTDFTLTISSVKAEDLAVYYCQQYYSYPLTFGAGTKLELK

SEQ ID NO: 194 - protein, 111 aa, Artificial Sequence
  Synthetic Sequence
DIVLTQSPASLAVSLGQRATISCRASQSVSTSSYSYVHWYQQKPGQPPKLLIKYASNLESGVPARFSGSGSGTDFTLNIHPVEEEDTATYYCQHSWEIPYTFGGGTKLEIK

SEQ ID NO: 195 - protein, 107 aa, Artificial Sequence
  Synthetic Sequence
DIQMTQSPSSLSASVGDRVTITCKASQSVSNDVAWYQQKPGKAPKLLIYYAANRYTGVPDRFSGSGYGTDFTFTISSLQPEDIATYFCQQDYTSPYTFGQGTKLEIK

SEQ ID NO: 196 - protein, 111 aa, Artificial Sequence
  Synthetic Sequence
DIVLTQSPASLAVSPGQRATITCRASQSVSTSSSSFMHWYQQKPGQPPKLLIKYASNLESGVPARFSGSGSGTDFTLTINPVEANDTANYYCQHSWEIPYTFGQGTKLEIK

SEQ ID NO: 197 - protein, 117 aa, Artificial Sequence
  Synthetic Sequence
EVQLVQSGAEVKKPGESLRISCKGSGYTFTTYWMHWVRQATGQGLEWMGNIYPGTGGSNFDEKFKNRVTITADKSTSTAYMELSSLRSEDTAVYYCTRWTTGTGAYWGQGTTVTVSS

SEQ ID NO: 198 - protein, 117 aa, Artificial Sequence
  Synthetic Sequence
EVQLVQSGAEVKKPGESLRISCKGSGYTFTTYWMHWIRQSPSRGLEWLGNIYPGTGGSNFDEKFKNRFTISRDNSKNTLYLQMNSLRAEDTAVYYCTRWTTGTGAYWGQGTTVTVSS

SEQ ID NO: 199 - protein, 117 aa, Artificial Sequence
  Synthetic Sequence
QVQLVQSGAEVKKPGASVKVSCKASGYTFTTYWMHWIRQSPSRGLEWLGNIYPGTGGSNFDEKFKNRFTISRDNSKNTLYLQMNSLRAEDTAVYYCTRWTTGTGAYWGQGTTVTVSS

SEQ ID NO: 200 - protein, 117 aa, Artificial Sequence
  Synthetic Sequence
EVQLVQSGAEVKKPGESLRISCKGSGYTFTTYWMHWVRQAPGQGLEWMGNIYPGTGGSNFDEKFKNRFTISRDNSKNTLYLQMNSLRAEDTAVYYCTRWTTGTGAYWGQGTTVTVSS

SEQ ID NO: 201 - protein, 113 aa, Artificial Sequence
  Synthetic Sequence
EIVLTQSPATLSLSPGERATLSCKSSQSLLDSGNQKNFLTWYQQKPGQAPRLLIYWASTRESGVPSRFSGSGSGTEFTLTISSLQPDDFATYYCQNDYSYPYTFGQGTKVEIK

SEQ ID NO: 202 - protein, 113 aa, Artificial Sequence
  Synthetic Sequence
DIQMTQSPSSLSASVGDRVTITCKSSQSLLDSGNQKNFLTWYQQKPGQAPRLLIYWASTRESGIPPRFSGSGYGTDFTLTINNIESEDAAYYFCQNDYSYPYTFGQGTKVEIK

SEQ ID NO: 203 - protein, 113 aa, Artificial Sequence
  Synthetic Sequence
EIVLTQSPATLSLSPGERATLSCKSSQSLLDSGNQKNFLTWYQQKPGKAPKLLIYWASTRESGVPSRFSGSGSGTDFTFTISSLQPEDIATYYCQNDYSYPYTFGQGTKVEIK

SEQ ID NO: 204 - protein, 113 aa, Artificial Sequence
  Synthetic Sequence
DIVMTQTPLSLPVTPGEPASISCKSSQSLLDSGNQKNFLTWYQQKPGQAPRLLIYWASTRESGVPSRFSGSGSGTDFTFTISSLEAEDAATYYCQNDYSYPYTFGQGTKVEIK

SEQ ID NO: 205 - protein, 113 aa, Artificial Sequence
  Synthetic Sequence
EIVLTQSPATLSLSPGERATLSCKSSQSLLDSGNQKNFLTWYQQKPGKAPKLLIYWASTRESGVPSRFSGSGSGTDFTFTISSLEAEDAATYYCQNDYSYPYTFGQGTKVEIK

SEQ ID NO: 206 - protein, 113 aa, Artificial Sequence
  Synthetic Sequence
EIVLTQSPDFQSVTPKEKVTITCKSSQSLLDSGNQKNFLTWYQQKPGQAPRLLIYWASTRESGVPSRFSGSGSGTDFTFTISSLEAEDAATYYCQNDYSYPYTFGQGTKVEIK

SEQ ID NO: 207 - protein, 113 aa, Artificial Sequence
  Synthetic Sequence
EIVLTQSPATLSLSPGERATLSCKSSQSLLDSGNQKNFLTWYQQKPGQAPRLLIYWASTRESGVPSRFSGSGSGTDFTFTISSLEAEDAATYYCQNDYSYPYTFGQGTKVEIK

SEQ ID NO: 208 - protein, 113 aa, Artificial Sequence
  Synthetic Sequence
DIQMTQSPSSLSASVGDRVTITCKSSQSLLDSGNQKNFLTWYLQKPGQSPQLLIYWASTRESGVPSRFSGSGSGTDFTFTISSLEAEDAATYYCQNDYSYPYTFGQGTKVEIK

SEQ ID NO: 209 - protein, 113 aa, Artificial Sequence
  Synthetic Sequence
DVVMTQSPLSLPVTLGQPASISCKSSQSLLDSGNQKNFLTWYQQKPGKAPKLLIYWASTRESGVPSRFSGSGSGTDFTFTISSLEAEDAATYYCQNDYSYPYTFGQGTKVEIK

SEQ ID NO: 210 - protein, 118 aa, Artificial Sequence
  Synthetic Sequence
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSA

SEQ ID NO: 211 - protein, 108 aa, Artificial Sequence
  Synthetic Sequence
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKR

SEQ ID NO: 212 - protein, 126 aa, Artificial Sequence
  Synthetic Sequence
EVQLVESGGGLVQPGGSLRLSCAASGFTLDYYAIGWFRQAPGKEREWASSISSSDGSTYYADSVKGRFTISRDNAKNTVFLQMNSLKPEDTAVYSCAASQAPITIATMMKPFYDYWGQGTQVTVSS

SEQ ID NO: 213 - protein, 123 aa, Artificial Sequence
  Synthetic Sequence
EVQLVESGGGLVQPGGSLRLSCAASGFTLDYYAKCWFRQAPGKEREWVSCISSSDGSTYYADSVKGRFTISRDNAKNTVYLQMNSLKPEDTAVYFCAARHGGPLTVEYFFDYWGQGTQVTVSS

SEQ ID NO: 214 - protein, 124 aa, Artificial Sequence
  Synthetic Sequence
EVQLVESGGGLVQPGGSLRLSCAASGFTFDYYAIGWFRQAPGKAREGVSCISGGDNSTYYADSVKGRFTISRDNAKNTVYLQMNSLKPEDTAVYYCATGGWKYCSGYDPEYIYWGQGTQVTVSS

SEQ ID NO: 215 - protein, 115 aa, Artificial Sequence
  Synthetic Sequence
EVQLVESGGGLVQAGGSLRLSCAASGSTFSQYDVGWYRQAPGKQRELVAFSSSGGRTIYPDSVKGRFTFSRDNTKNTVYLQMTSLKPEDTAVYYCKIDWYLNSYWGQGTQVTVSS

SEQ ID NO: 216 - protein, 114 aa, Artificial Sequence
  Synthetic Sequence
EVQLVESGGGLVQAGGSLRLSCAASGVDASNSAMGWYRQAPGKQREWVARITGGGLIAYTDSVKGRFTISRDNAKSTVYLQMNSLEPEDTAVYYCNTINSRDGWGQGTQVTVSS

SEQ ID NO: 217 - protein, 111 aa, Artificial Sequence
  Synthetic Sequence
EVQLVESGGGLVQAGGSLTISCAASGITFSDSIVSWYRRARGKQREWVAGISNGGTTKYAESVLGRFTISRDNAKNNVYLQMNGLNPEDTAVYLCKVRQYWGQGTQVTVSS

SEQ ID NO: 218 - protein, 130 aa, Artificial Sequence
  Synthetic Sequence
EVQLVESGGGLVQAGGSLRLSCAASESTVLINAMGWYRQAPGKQRELVASISSGGSTNYADSVKGRFTISRDNAKNTVYLQMNSLKPEDTAVYYCNADVYPQDYGLGYVEGKVYYGHDYWGTGTLVTVSS

SEQ ID NO: 219 - protein, 119 aa, Artificial Sequence
  Synthetic Sequence
EVQLVESGGGLVQAGGSLRLSCAASGSTFSNYVSNYAMGWGRQAPGTQRELVASISNGDTTNYADSVKGRFTISRDNAKNTVYLQMNSLKPEDTAVYYCFEHQVAGLTWGQGTQVTVSS

SEQ ID NO: 220 - protein, 118 aa, Artificial Sequence
  Synthetic Sequence
  misc_feature (27)..(27): Xaa can be any naturally occurring amino acid
  misc_feature (32)..(32): Xaa can be any naturally occurring amino acid
  misc_feature (75)..(75): Xaa can be any naturally occurring amino acid
EVQLVESGGGLVQAGGSLRLSCVASGXALKIXVMGWYRQAPGKQRELVAAITSGGRTNYSDSVKGRFTISGDNAXNTVYLQMNSLKSEDTAVYYCREWNSGYPPVDYWGQGTQVTVSS

SEQ ID NO: 221 - protein, 120 aa, Artificial Sequence
  Synthetic Sequence
EVQLVESGGGLVQAGGSLRLSCAASGRTFSSGTMGWFRRAPGKEREFVASIPWSGGRTYYADSVKDRFTISRDNAQNTVFLQMNSLKPEDTAVYYCAFKERSTGWDFASWGQGIQVTVSS

SEQ ID NO: 222 - protein, 127 aa, Artificial Sequence
  Synthetic Sequence
EVQLVESGGGLVQTGGSLRLSCAASGFTLDYYGIGWFRQAPGKEREGVSFISGSDGSTYYAESVKGRFTISRDKAKNTVYLQMNSLKPEDTAVYYCAADPWGPPSIATMTSYEYKHWGQGTQVTVSS

SEQ ID NO: 223 - protein, 113 aa, Artificial Sequence
  Synthetic Sequence
EVQLVESGGGLVQPGGSLRLSCAASGFTFSTYTMIWLRRAPGKGFEWVSTIDKDGNTNYVDSVKGRFAVSRDNTKNTLYLQMNSLKPEDTAMYYCTKHGSSARGQGTRVTVSS

SEQ ID NO: 224 - protein, 114 aa, Artificial Sequence
  Synthetic Sequence
EVQLVESGGGLVEPGGSLRLSCVASGFTFSSYDMSWVRQAPGKGLEWVSTINSGGGITYRGSVKGRFTISRDNAKNTLYLQMNSLKPEDTAVYYCENGGSSYRRGQGTQVTVSS

SEQ ID NO: 225 - protein, 114 aa, Artificial Sequence
  Synthetic Sequence
QVQLVQSGAELKKPGASVKMSCKASGYTFTGYTMHWVKQAPGQGLEWIGYINPRSGYTEYNQKFKDRTTLTADKSTSTAYMELSSLRSEDSAVYYCARPWFAYWGQGTLVTVSS

SEQ ID NO: 226 - protein, 114 aa, Artificial Sequence
  Synthetic Sequence
QVQLVQSGAEVKKPGASVKMSCKASGYTFTGYTMHWVKQAPGQGLEWIGYINPRSGYTEYNQKFKDRTTLTADKSTSTAYMELSSLRSEDTAVYYCARPWFAYWGQGTLVTVSS

SEQ ID NO: 227 - protein, 114 aa, Artificial Sequence
  Synthetic Sequence
QVQLVQSGAEVKKPGASVKMSCKASGYTFTGYTMHWVRQAPGQGLEWIGYINPRSGYTEYNQKFKDRTTLTADKSTSTAYMELSSLRSEDTAVYYCARPWFAYWGQGTLVTVSS

SEQ ID NO: 228 - protein, 114 aa, Artificial Sequence
  Synthetic Sequence
QVQLVQSGAEVKKPGASVKVSCKASGYTFTGYTMHWVRQAPGQGLEWIGYINPRSGYTEYNQKFKDRTTLTADKSTSTAYMELSSLRSEDTAVYYCARPWFAYWGQGTLVTVSS

SEQ ID NO: 229 - protein, 114 aa, Artificial Sequence
  Synthetic Sequence
QVQLVQSGAEVKKPGASVKVSCKASGYTFTGYTMHWVRQAPGQGLEWIGYINPRSGYTEYNQKFKDRTTITADKSTSTAYMELSSLRSEDTAVYYCARPWFAYWGQGTLVTVSS

SEQ ID NO: 230 - protein, 113 aa, Artificial Sequence
  Synthetic Sequence
DIVMTQSPASLTVTPGEKVTITCKSSQSLLNSGNQKNYLTWYQQKPGQPPKLLIYWASTRESGVPDRFTGSGSGTDFTLTISSLQAEDVAVYYCQNDYSYPLTFGQGTKLEIK

SEQ ID NO: 231 - protein, 113 aa, Artificial Sequence
  Synthetic Sequence
DIVMTQSPASLSVTPGEKVTITCKSSQSLLNSGNQKNYLTWYQQKPGQPPKLLIYWASTRESGVPDRFTGSGSGTDFTLTISSLQAEDVAVYYCQNDYSYPLTFGQGTKLEIK

SEQ ID NO: 232 - protein, 113 aa, Artificial Sequence
  Synthetic Sequence
DIVMTQSPAFLSVTPGEKVTITCKSSQSLLNSGNQKNYLTWYQQKPGQPPKLLIYWASTRESGVPDRFTGSGSGTDFTLTISSLQAEDVAVYYCQNDYSYPLTFGQGTKLEIK

SEQ ID NO: 233 - protein, 113 aa, Artificial Sequence
  Synthetic Sequence
DIVMTQSPAFLSVTPGEKVTITCKSSQSLLNSGNQKNYLTWYQQKPGQPPKLLIYWASTRESGVPDRFSGSGSGTDFTLTISSLQAEDVAVYYCQNDYSYPLTFGQGTKLEIK

SEQ ID NO: 234 - protein, 165 aa, Artificial Sequence
  Synthetic Sequence
CDLPQTHSLGSRRTLMLLAQMRKISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 235 - protein, 165 aa, Artificial Sequence [sequence omitted]

SEQ ID NO: 236 - protein, 166 aa, Artificial Sequence
  Synthetic Sequence
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 237 - protein, 165 aa, Artificial Sequence
  Synthetic Sequence
APMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRCDKPRR

SEQ ID NO: 238 - protein, 165 aa, Artificial Sequence
  Synthetic Sequence
APMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRSLTRKD

SEQ ID NO: 239 - protein, 157 aa, Artificial Sequence [sequence omitted]

SEQ ID NO: 240 - protein, 171 aa, Artificial Sequence
  Synthetic Sequence
LPGVGLTPSAAQTARQHPKMHLAHSNLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 241 - protein, 281 aa, Artificial Sequence [sequence omitted]

SEQ ID NO: 242 - protein, 153 aa, Artificial Sequence
  Synthetic Sequence
APVRSLNCTLRDSQQKSLVMSGPYELKALHLQGQDMEQQVVFSMSFVQGEESNDKIPVALGLKEKNLYLSCVLKDDKPTLQLESVDPKNYPKKKMEKRFVFNKIEINNKLEFESAQFPNWYISTSQAENMPVFLGGTKGGQDITDFTMQFVSS

SEQ ID NO: 243 - protein, 133 aa, Artificial Sequence [sequence omitted]

SEQ ID NO: 244 - protein, 129 aa, Artificial Sequence [sequence omitted]

SEQ ID NO: 245 - protein, 185 aa, Artificial Sequence
  Synthetic Sequence
APVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLTTKLQAQNQWLQDMTTHLILRSFKEFLQSSLRALRQM

SEQ ID NO: 246 - protein, 114 aa, Artificial Sequence
  Synthetic Sequence
SPGPVPPSTALRELIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFN

SEQ ID NO: 247 - protein, 194 aa, Artificial Sequence
  Synthetic Sequence
MAAEPVEDNCINFVAMKFIDNTLYFIAEDDENLESDYFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNEDL

SEQ ID NO: 248 - protein, 270 aa, Artificial Sequence
  Synthetic Sequence
MKPKMKYSTNKISTAKWKNTASKALCFKLGKSQQKAKEVCPMYFMKLRSGLMIKKEACYFRRETTKRPSLKTGRKHKRHLVLAACQQQSTVECFAFGISGVQKYTRALHDSSITGISPITEYLASLSTYNDQSITFALEDESYEIYVEDLKKDEKKDKVLLSYYESQHPSNESGDGVDGKMLMVTLSPTKDFWLHANNKEHSVELHKCEKPLPDQAFFVLHNMHSNCVSFECKTDPGVFIGVKDNHLALIKVDSSENLCTENILFKLSET

SEQ ID NO: 249 - protein, 193 aa, Artificial Sequence
  Synthetic Sequence
MGVHECPAWLWLLLSLLSLPLGLPVLGAPPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 250 - protein, 166 aa, Artificial Sequence
  Synthetic Sequence
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 251 - protein, 16 aa, Artificial Sequence
  Synthetic Sequence
GGSGGSGGGGSGGGGS

SEQ ID NO: 252 - protein, 5 aa, Artificial Sequence
  Synthetic Sequence
GGGGS

SEQ ID NO: 253 - protein, 20 aa, Artificial Sequence
  Synthetic Sequence
  REPEAT (1)..(5): (GGGGS)n (n=1-4)
GGGGSGGGGSGGGGSGGGGS

SEQ ID NO: 254 - protein, 8 aa, Artificial Sequence
  Synthetic Sequence
GGGGGGGG

SEQ ID NO: 255 - protein, 6 aa, Artificial Sequence
  Synthetic Sequence
GGGGGG

SEQ ID NO: 256 - protein, 15 aa, Artificial Sequence
  Synthetic Sequence
  REPEAT (1)..(5): (EAAAK)n (n=1-3)
EAAAKEAAAKEAAAK

SEQ ID NO: 257 - protein, 27 aa, Artificial Sequence
  Synthetic Sequence
  REPEAT (2)..(6): A(EAAAK)nA (n = 2-5)
AEAAAKEAAAKEAAAKEAAAKEAAAKA

SEQ ID NO: 258 - protein, 12 aa, Artificial Sequence
  Synthetic Sequence
AEAAAKEAAAKA

SEQ ID NO: 259 - protein, 46 aa, Artificial Sequence
  Synthetic Sequence
AEAAAKEAAAKEAAAKEAAAKALEAEAAAKEAAAKEAAAKEAAAKA

SEQ ID NO: 260 - protein, 5 aa, Artificial Sequence
  Synthetic Sequence
PAPAP

SEQ ID NO: 261 - protein, 18 aa, Artificial Sequence
  Synthetic Sequence
KESGSVSSEQLAQFRSLD

SEQ ID NO: 262 - protein, 14 aa, Artificial Sequence
  Synthetic Sequence
EGKSSGSGSESKST

SEQ ID NO: 263 - protein, 12 aa, Artificial Sequence
  Synthetic Sequence
GSAGSAAGSGEF

SEQ ID NO: 264 - protein, 10 aa, Artificial Sequence
  Synthetic Sequence
GFTFDDYAMS

SEQ ID NO: 265 - protein, 10 aa, Artificial Sequence
  Synthetic Sequence
GFTFDDYAIG

SEQ ID NO: 266 - protein, 17 aa, Artificial Sequence
  Synthetic Sequence
TINWNGGSAEYAEPVKG

SEQ ID NO: 267 - protein, 17 aa, Artificial Sequence
  Synthetic Sequence
CIRVSDGSTYYADPVKG

SEQ ID NO: 268 - protein, 11 aa, Artificial Sequence
  Synthetic Sequence
KDADLVWYNLS

SEQ ID NO: 269 - protein, 11 aa, Artificial Sequence
  Synthetic Sequence
KDADLVWYNLR

SEQ ID NO: 270 - protein, 24 aa, Artificial Sequence
  Synthetic Sequence
AGSLYTCVQSIVVVPARPYYDMDY

SEQ ID NO: 271 - protein, 132 aa, Artificial Sequence
  Synthetic Sequence
QVQLQESGGGSVQPGGSLRLSCAASGFTFDDYAMSWVRQVPGKGLEWVSTINWNGGSAEYAEPVKGRFTISRDNAKNTVYLQMNSLKLEDTAVYYCAKDADLVWYNLSTGQGTQVTVSSAAAYPYDVPDYGS

SEQ ID NO: 272 - protein, 132 aa, Artificial Sequence
  Synthetic Sequence
QVQLQESGGGLVQPGGSLRLSCAASGFTFDDYAMSWVRQVPGKGLEWVSTINWNGGSAEYAEPVKGRFTISRDNAKNTVYLQMNSLKLEDTAVYYCAKDADLVWYNLRTGQGTQVTVSSAAAYPYDVPDYGS

SEQ ID NO: 273 - protein, 145 aa, Artificial Sequence
  Synthetic Sequence
QVQLQESGGGLVQAGGSLRLSCAASGFTFDDYAIGWFRQAPGKEREGVSCIRVSDGSTYYADPVKGRFTISSDNAKNTVYLQMNSLKPEDAAVYYCAAGSLYTCVQSIVVVPARPYYDMDYWGKGTQVTVSSAAAYPYDVPDYGS

SEQ ID NO: 274 - protein, 10 aa, Artificial Sequence
  Synthetic Sequence
GRSFSSYTLA

SEQ ID NO: 275 - protein, 10 aa, Artificial Sequence
  Synthetic Sequence
GRTFSSYTMG

SEQ ID NO: 276 - protein, 10 aa, Artificial Sequence
  Synthetic Sequence
GRTFSSYIMG

SEQ ID NO: 277 - protein, 14 aa, Artificial Sequence
  Synthetic Sequence
GRTSGRTFSSYTMG

SEQ ID NO: 278 - protein, 10 aa, Artificial Sequence
  Synthetic Sequence
GRTFSSYAMG

SEQ ID NO: 279 - protein, 10 aa, Artificial Sequence
  Synthetic Sequence
GLTFSNYIMG

SEQ ID NO: 280 - protein, 10 aa, Artificial Sequence
  Synthetic Sequence
GRTFSSDTMG

SEQ ID NO: 281 - protein, 10 aa, Artificial Sequence
  Synthetic Sequence
GFTLDYYGIG

SEQ ID NO: 282 - protein, 10 aa, Artificial Sequence
  Synthetic Sequence
GHTFSSYTMG

SEQ ID NO: 283 - protein, 10 aa, Artificial Sequence
  Synthetic Sequence
GRTFSSYVIG

SEQ ID NO: 284 - protein, 10 aa, Artificial Sequence
  Synthetic Sequence
GFAFDGYAIG

SEQ ID NO: 285 - protein, 10 aa, Artificial Sequence
  Synthetic Sequence
GFAFGFFDMT

SEQ ID NO: 286 - protein, 10 aa, Artificial Sequence
  Synthetic Sequence
GRTFSNYVIG

SEQ ID NO: 287 - protein, 10 aa, Artificial Sequence
  Synthetic Sequence
GSIFSINVMG

SEQ ID NO: 288 - protein, 10 aa, Artificial Sequence
  Synthetic Sequence
GRTFSNYNVG

SEQ ID NO: 289 - protein, 10 aa, Artificial Sequence
  Synthetic Sequence
GRTFSTYPVG

SEQ ID NO: 290 - protein, 10 aa, Artificial Sequence
  Synthetic Sequence
GRTFSNYAMG

SEQ ID NO: 291 - protein, 10 aa, Artificial Sequence
  Synthetic Sequence
GRTFSDYRMG

SEQ ID NO: 292 - protein, 10 aa, Artificial Sequence
  Synthetic Sequence
GLTFSNYIMA

SEQ ID NO: 293 - protein, 10 aa, Artificial Sequence
  Synthetic Sequence
GRTFSNSVMG

SEQ ID NO: 294 - protein, 10 aa, Artificial Sequence
  Synthetic Sequence
GRTFSSYIIG

SEQ ID NO: 295 - protein, 10 aa, Artificial Sequence
  Synthetic Sequence
GRTFSSYVMG

SEQ ID NO: 296 - protein, 10 aa, Artificial Sequence
  Synthetic Sequence
GGTFSNYVMG

SEQ ID NO: 297 - protein, 10 aa, Artificial Sequence
  Synthetic Sequence
GRTFSNYGIG

SEQ ID NO: 298 - protein, 10 aa, Artificial Sequence
  Synthetic Sequence
GFTFDDYAIA

SEQ ID NO: 299 - protein, 10 aa, Artificial Sequence
  Synthetic Sequence
GRTFSSYTVA

SEQ ID NO: 300 - protein, 10 aa, Artificial Sequence
  Synthetic Sequence
GFPFDDYAIA

SEQ ID NO: 301 - protein, 10 aa, Artificial Sequence
  Synthetic Sequence
GRTLSSNPMA

SEQ ID NO: 302 - protein, 10 aa, Artificial Sequence
  Synthetic Sequence
GFTFDNYAIG

SEQ ID NO: 303 - protein, 10 aa, Artificial Sequence
  Synthetic Sequence
GRAFSSYFMG

SEQ ID NO: 304 - protein, 10 aa, Artificial Sequence
  Synthetic Sequence
TPTFSSYNMG

SEQ ID NO: 305 - protein, 10 aa, Artificial Sequence
  Synthetic Sequence
GGTFSGYIMG

SEQ ID NO: 306 - protein, 10 aa, Artificial Sequence
  Synthetic Sequence
GRSFSSYTIA

SEQ ID NO: 307 - protein, 10 aa, Artificial Sequence
  Synthetic Sequence
GFSSDDYTIG

SEQ ID NO: 308 - protein, 10 aa, Artificial Sequence
  Synthetic Sequence
GFTFDDYTIG

SEQ ID NO: 309 - protein, 10 aa, Artificial Sequence
  Synthetic Sequence
GFTFDQYTIA

SEQ ID NO: 310 - protein, 10 aa, Artificial Sequence
  Synthetic Sequence
GRTFSSYAMA

SEQ ID NO: 311 - protein, 10 aa, Artificial Sequence
  Synthetic Sequence
GFSSDDYTIA

SEQ ID NO: 312 - protein, 10 aa, Artificial Sequence
  Synthetic Sequence
GFSFDDYAIA

SEQ ID NO: 313 - protein, 10 aa, Artificial Sequence
  Synthetic Sequence
GFTGNDLAIG

SEQ ID NO: 314 - protein, 10 aa, Artificial Sequence
  Synthetic Sequence
EGTLSSYGIG

SEQ ID NO: 315 - protein, 10 aa, Artificial Sequence
  Synthetic Sequence
GLSSDDYTIG

SEQ ID NO: 316 - protein, 10 aa, Artificial Sequence
  Synthetic Sequence
GFSFDDYTIG

SEQ ID NO: 317 - protein, 10 aa, Artificial Sequence
  Synthetic Sequence
GFTFGDYTIG

SEQ ID NO: 318 - protein, 10 aa, Artificial Sequence
  Synthetic Sequence
EGTFSSYGIG

SEQ ID NO: 319 - protein, 10 aa, Artificial Sequence
  Synthetic Sequence
GVSIGDYNIG

SEQ ID NO: 320 - protein, 10 aa, Artificial Sequence
  Synthetic Sequence
GFTFDDYTIA

SEQ ID NO: 321 - protein, 11 aa, Artificial Sequence
  Synthetic Sequence
ASITWGGGNTY

SEQ ID NO: 322 - protein, 11 aa, Artificial Sequence
  Synthetic Sequence
AATVWTGAGTV

SEQ ID NO: 323 - protein, 11 aa, Artificial Sequence
  Synthetic Sequence
AAIGWSADITV

SEQ ID NO: 324 - protein, 11 aa, Artificial Sequence
  Synthetic Sequence
AFIDWSGGGTY

SEQ ID NO: 325 - protein, 11 aa, Artificial Sequence
  Synthetic Sequence
ATITWGGGSTY

SEQ ID NO: 326 - protein, 11 aa, Artificial Sequence
  Synthetic Sequence
AAISWSGGPTV

SEQ ID NO: 327 - protein, 11 aa, Artificial Sequence
  Synthetic Sequence
AAITWGGGSTV

SEQ ID NO: 328 - protein, 11 aa, Artificial Sequence
  Synthetic Sequence
AAITWSGVSTV

SEQ ID NO: 329 - protein, 11 aa, Artificial Sequence
  Synthetic Sequence
GAIMWSGAFTH

SEQ ID NO: 330 - protein, 11 aa, Artificial Sequence
  Synthetic Sequence
SCISSSDRNTY

SEQ ID NO: 331 - protein, 11 aa, Artificial Sequence
  Synthetic Sequence
AVITWSGDSTY

SEQ ID NO: 332 - protein, 11 aa, Artificial Sequence
  Synthetic Sequence
ACISSKDGSTY

SEQ ID NO: 333 - protein, 11 aa, Artificial Sequence
  Synthetic Sequence
SGINSIGGSTT

SEQ ID NO: 334 - protein, 11 aa, Artificial Sequence
  Synthetic Sequence
AVVTWSGDSTY

SEQ ID NO: 335 - protein, 10 aa, Artificial Sequence
  Synthetic Sequence
AKITNFGITS

SEQ ID NO: 336 - protein, 11 aa, Artificial Sequence
  Synthetic Sequence
SFISWISDITY

SEQ ID NO: 337 - protein, 11 aa, Artificial Sequence
  Synthetic Sequence
AVILWSGVSTY

SEQ ID NO: 338 - protein, 11 aa, Artificial Sequence
  Synthetic Sequence
AAIVWSGGSTY

SEQ ID NO: 339 - protein, 11 aa, Artificial Sequence
  Synthetic Sequence
AAISSSGYHTY

SEQ ID NO: 340 - protein, 11 aa, Artificial Sequence
  Synthetic Sequence
SCISSPDGSTY

SEQ ID NO: 341 - protein, 11 aa, Artificial Sequence
  Synthetic Sequence
AAVLWSGVSTA

SEQ ID NO: 342 - protein, 11 aa, Artificial Sequence
  Synthetic Sequence
VAITWDGSATT

SEQ ID NO: 343 - protein, 11 aa, Artificial Sequence
  Synthetic Sequence
AAIGWNGGITY

SEQ ID NO: 344 - protein, 11 aa, Artificial Sequence
  Synthetic Sequence
GFITWSGASTY

SEQ ID NO: 345 - protein, 11 aa, Artificial Sequence
  Synthetic Sequence
AGINWSGESAD

SEQ ID NO: 346 - protein, 11 aa, Artificial Sequence
  Synthetic Sequence
SCIERSDGSTY

SEQ ID NO: 347 - protein, 11 aa, Artificial Sequence
  Synthetic Sequence
SCISNTDSSTY

SEQ ID NO: 348 - protein, 11 aa, Artificial Sequence
  Synthetic Sequence
AQISWSAGSIY

SEQ ID NO: 349 - protein, 11 aa, Artificial Sequence
  Synthetic Sequence
AGMSWNPGPAV

SEQ ID NO: 350 - protein, 11 aa, Artificial Sequence
  Synthetic Sequence
SCISRSDGSTY

SEQ ID NO: 351 - protein, 11 aa, Artificial Sequence
  Synthetic Sequence
ANIGWTGDMTY

SEQ ID NO: 352 - protein, 11 aa, Artificial Sequence
  Synthetic Sequence
AAIIWSGSMTY

SEQ ID NO: 353 - protein, 11 aa, Artificial Sequence
  Synthetic Sequence
AANTWSGGPTY

SEQ ID NO: 354 - protein, 10 aa, Artificial Sequence
  Synthetic Sequence
SCISSDGSTG

SEQ ID NO: 355 - protein, 11 aa, Artificial Sequence
  Synthetic Sequence
SCYSSSDGSTG

SEQ ID NO: 356 - protein, 11 aa, Artificial Sequence
  Synthetic Sequence
GCIKSSDGTTG

SEQ ID NO: 357 - protein, 11 aa, Artificial Sequence
  Synthetic Sequence
AAIAWSAGSTY

SEQ ID NO: 358 - protein, 11 aa, Artificial Sequence
  Synthetic Sequence
SCISSKEGSTY

SEQ ID NO: 359 - protein, 11 aa, Artificial Sequence
  Synthetic Sequence
SCISSSDGSTG

SEQ ID NO: 360 - protein, 11 aa, Artificial Sequence
  Synthetic Sequence
SCYSSRDGTTG

SEQ ID NO: 361 - protein, 11 aa, Artificial Sequence
  Synthetic Sequence
SCFSSSDGSTG

SEQ ID NO: 362 - protein, 11 aa, Artificial Sequence
  Synthetic Sequence
SCISNTDSSTF

SEQ ID NO: 363 - protein, 11 aa, Artificial Sequence
  Synthetic Sequence
GGINWSGDSTD

SEQ ID NO: 364 - protein, 11 aa, Artificial Sequence
  Synthetic Sequence
SCFSSSDGSAG

SEQ ID NO: 365 - protein, 11 aa, Artificial Sequence
  Synthetic Sequence
SCFSTRDGNAG

SEQ ID NO: 366 - protein, 11 aa, Artificial Sequence
  Synthetic Sequence
SCFSSRDGSTG

SEQ ID NO: 367 - protein, 11 aa, Artificial Sequence
  Synthetic Sequence
SCYSSSDGNTG

SEQ ID NO: 368 - protein, 11 aa, Artificial Sequence
  Synthetic Sequence
SCISSGDGTTY

SEQ ID NO: 369 - protein, 19 aa, Artificial Sequence
  Synthetic Sequence
AKGLRNSDWDLRRGYEYDY

SEQ ID NO: 370 - protein, 25 aa, Artificial Sequence
  Synthetic Sequence
ADQASVPPPYGSERYDIASPSEYDY

SEQ ID NO: 371 - protein, 21 aa, Artificial Sequence
  Synthetic Sequence
ANSRAYYSSSYDLGRLASYDY

SEQ ID NO: 372 - protein, 16 aa, Artificial Sequence
  Synthetic Sequence
AAQRLGSVTDYTKYDY

SEQ ID NO: 373 - protein, 21 aa, Artificial Sequence
  Synthetic Sequence
ASVKVVAGSGIDISGSRNYDY

SEQ ID NO: 374 - protein, 21 aa, Artificial Sequence
  Synthetic Sequence
AKRLDYSATDKGVDLSDEYDY

SEQ ID NO: 375 - protein, 19 aa, Artificial Sequence
  Synthetic Sequence
AAGGSGRLRDLKVGQNYDY

SEQ ID NO: 376 - protein, 23 aa, Artificial Sequence
  Synthetic Sequence
ADSPPRTYSSGSVNLEDGSEYDY

SEQ ID NO: 377 - protein, 21 aa, Artificial Sequence
  Synthetic Sequence
VIPGRGSALPIDVGKSDEYEY

SEQ ID NO: 378 - protein, 19 aa, Artificial Sequence
  Synthetic Sequence
AAGASGRLRDLKVGQNYDY

SEQ ID NO: 379 - protein, 23 aa, Artificial Sequence
  Synthetic Sequence
ADGNVWSPPICGSAGPPPGGMDY

SEQ ID NO: 380 - protein, 22 aa, Artificial Sequence
  Synthetic Sequence
AIPPRAYSGGSYSLKDQSKYEY

SEQ ID NO: 381 - protein, 23 aa, Artificial Sequence
  Synthetic Sequence
ADGNVWSPPICSSAGPPPGGMDY

SEQ ID NO: 382 - protein, 9 aa, Artificial Sequence
  Synthetic Sequence
KSRSSYSNN

SEQ ID NO: 383 - protein, 22 aa, Artificial Sequence
  Synthetic Sequence
AMPPRAYTGRSVSLKDQSKYEY

SEQ ID NO: 384 - protein, 13 aa, Artificial Sequence
  Synthetic Sequence
LDTTGWGPPPYQY

SEQ ID NO: 385 - protein, 22 aa, Artificial Sequence
  Synthetic Sequence
AHPPDPSRGGEWRLQTPSEYDY

SEQ ID NO: 386 - protein, 24 aa, Artificial Sequence
  Synthetic Sequence
VPRSHFTTAQDMGQDMGAPSWYEY

SEQ ID NO: 387 - protein, 22 aa, Artificial Sequence
  Synthetic Sequence
AVLIRYYSGGYQGLSDANEYDY

SEQ ID NO: 388 - protein, 17 aa, Artificial Sequence
  Synthetic Sequence
VVKYLSGSYSYAGQYNF

SEQ ID NO: 389 - protein, 23 aa, Artificial Sequence
  Synthetic Sequence
ADFNVWSPPICGSVGPPPGGMDY

SEQ ID NO: 390 - protein, 21 aa, Artificial Sequence
  Synthetic Sequence
AHESTYYSGTYYLTDPRRYVY

SEQ ID NO: 391 - protein, 19 aa, Artificial Sequence
  Synthetic Sequence
AVPARGLTMDLENSDIYDH

SEQ ID NO: 392 - protein, 22 aa, Artificial Sequence
  Synthetic Sequence
AATLQVTGSYYLDLSTVDIYDN

SEQ ID NO: 393 - protein, 20 aa, Artificial Sequence
  Synthetic Sequence
ATLFRSNGPKDLSSGYEYDY

SEQ ID NO: 394 - protein, 13 aa, Artificial Sequence
  Synthetic Sequence
AGESGVWVGGLDY

SEQ ID NO: 395 - protein, 22 aa, Artificial Sequence
  Synthetic Sequence
VGSANSGEFRFGWVLKPDLYNY

SEQ ID NO: 396 - protein, 20 aa, Artificial Sequence
  Synthetic Sequence
ERGYAYCSDDGCQRTQDYDY

SEQ ID NO: 397 - protein, 21 aa, Artificial Sequence
  Synthetic Sequence
GAARAWWSGSYDYTRMNNYDY

SEQ ID NO: 398 - protein, 23 aa, Artificial Sequence
  Synthetic Sequence
AETSADSGEFRFGWVLKPSLYDY

SEQ ID NO: 399 - protein, 21 aa, Artificial Sequence
  Synthetic Sequence
AAGSAYSGSYWNITMAANYDY

SEQ ID NO: 400 - protein, 18 aa, Artificial Sequence
  Synthetic Sequence
AQRIFGAQPMDLSGDYEY

SEQ ID NO: 401 - protein, 18 aa, Artificial Sequence
  Synthetic Sequence
ARDYRGIKDLDLKGDYDY

SEQ ID NO: 402 - protein, 25 aa, Artificial Sequence
  Synthetic Sequence
ADFNVWSPPICGSIWYGPPPRGMDY

SEQ ID NO: 403 - protein, 25 aa, Artificial Sequence
  Synthetic Sequence
ADSNVWSPPICGSRWYGPPPGGMAY

SEQ ID NO: 404 - protein, 25 aa, Artificial Sequence
  Synthetic Sequence
ADFNVWSPPICGSNWYGPPPGGMDY

SEQ ID NO: 405 - protein, 25 aa, Artificial Sequence
  Synthetic Sequence
ADFNVWSPPICGSIWYGPPPGGMDY

SEQ ID NO: 406 - protein, 17 aa, Artificial Sequence
  Synthetic Sequence
ARIITVATMRLDSDYDY

SEQ ID NO: 407 - protein, 25 aa, Artificial Sequence
  Synthetic Sequence
ADSNVWSPPICGRTWYGPPPGGMDY

SEQ ID NO: 408 - protein, 25 aa, Artificial Sequence
  Synthetic Sequence
ADFNVWSPPICGSIWYGPPPGGMAY

SEQ ID NO: 409 - protein, 25 aa, Artificial Sequence
  Synthetic Sequence
ADFNVWSPPICGSSWYGPPPGGMDY

SEQ ID NO: 410 - protein, 25 aa, Artificial Sequence
  Synthetic Sequence
ADFNVWSPPICGSRWYGPPPGGMEY

SEQ ID NO: 411 - protein, 25 aa, Artificial Sequence
  Synthetic Sequence
ADFNVWSPPICGSRWYGPPPGGMAY

SEQ ID NO: 412 - protein, 25 aa, Artificial Sequence
  Synthetic Sequence
ADSNVWSPPICGKTWYGPPPGGMDY

SEQ ID NO: 413 - protein, 25 aa, Artificial Sequence
  Synthetic Sequence
ADSNVWSPPICGSTWYGPPPGGMAY

SEQ ID NO: 414 - protein, 25 aa, Artificial Sequence
  Synthetic Sequence
ADFNVWSPPICGSRWYGPPPGGMDY

SEQ ID NO: 415 - protein, 25 aa, Artificial Sequence
  Synthetic Sequence
ADFNVWSPPICGSSWYGPPPGGMAY

SEQ ID NO: 416 - protein, 25 aa, Artificial Sequence
  Synthetic Sequence
ADFNVWSPPICGSSWYGPPPGGMEY

SEQ ID NO: 417 - protein, 25 aa, Artificial Sequence
  Synthetic Sequence
ADFNVWSPPICSSNWYGPPPRGMDY

SEQ ID NO: 418 - protein, 146 aa, Artificial Sequence
  Synthetic Sequence
QVQLQESGGGLVQAGGSLRLSCAASGRSFSSYTLAWFRQAPGKEREFVASITWGGGNTYYPDSVKGRFTISRDDAKNTVYLQMNSLKPEDTAVYYCAAKGLRNSDWDLRRGYEYDYWGQGTQVTVSSAAAYPYDVPDYGSHHHHHH

SEQ ID NO: 419 - protein, 152 aa, Artificial Sequence
  Synthetic Sequence
QVQLQESGGGLVQDGGSLRLSCAFSGRTFSSYTMGWFRQGPGKEREFVAATVWTGAGTVYADSVKGRFTISRDNAKNTVYLQMNSLRPEDTAVYYCAADQASVPPPYGSERYDIASPSEYDYWGQGTQVTVSSAAAYPYDVPDYGSHHHHHH

SEQ ID NO: 420 - protein, 148 aa, Artificial Sequence
  Synthetic Sequence
QVQLQESGGGLVQAGASLRLSCAASGRTFSSYIMGWFRQAPGKEREFVAAIGWSADITVYADSVKGRFTISRDNAENMVYLQMNSLNPEDTAVYYCAANSRAYYSSSYDLGRLASYDYWGQGTQVTVSSAAAYPYDVPDYGSHHHHHH

SEQ ID NO: 421 - protein, 143 aa, Artificial Sequence
  Synthetic Sequence
QVQLQESGGGLVQAGGSLRLSCAASGRTFSSYTMGWFRQAPGKEREFVAFIDWSGGGTYYDDSVKGRFTISRDNAENTVYLQMNNLEPEDTAVYYCAAAQRLGSVTDYTKYDYWGQGTQVTVSSAAAYPYDVPDYGSHHHHHH

SEQ ID NO: 422 - protein, 152 aa, Artificial Sequence
  Synthetic Sequence
QVQLQESGGGLVQAGGSLRLSCAASGRTSGRTFSSYTMGWFRQAPGKEREFVATITWGGGSTYYADSVKGRFTISRDNANNTVYLQMNSLKPEDTAVYYCAASVKVVAGSGIDISGSRNYDYWGQGTQVTVSSAAAYPYDVPDYGSHHHHHH

SEQ ID NO: 423 - protein, 148 aa, Artificial Sequence
  Synthetic Sequence
QVQLQESGGGLVQPGGSLRLSCLASGRTFSSYAMGWFRQAPGKEREFVAAISWSGGPTVYADHVKGRFTISRDNAKNTVYLQVNSLKPEDTADYYCAAKRLDYSATDKGVDLSDEYDYWGQGTQVTVSSAAAYPYDVPDYGSHHHHHH

SEQ ID NO: 424 - protein, 146 aa, Artificial Sequence
  Synthetic Sequence
QVQLQESGGGLVQAGDSLRLSCAASGLTFSNYIMGWFRQAPGKEREFVAAITWGGGSTVYADSVEGRFTISRDGTKNTVSLQMNSLLPEDTAVYYCAAAGGSGRLRDLKVGQNYDYWGQGTQVTVSSAAAYPYDVPDYGSHHHHHH

SEQ ID NO: 425 - protein, 150 aa, Artificial Sequence
  Synthetic Sequence
QVQLQESGGGLVQAGGSLRLSCAASGRTFSSYTMGWFRQAPGREREFVAAITWSGVSTVYTDSVKGRFTVSRDNAKNTVYLQMNSLKPEDTAVYYCAADSPPRTYSSGSVNLEDGSEYDYWGQGTQVTVSSAAAYPYDVPDYGSHHHHHH

SEQ ID NO: 426 - protein, 148 aa, Artificial Sequence
  Synthetic Sequence
QVQLQESGGGLVQAGGSLRLSCAASGRTFSSDTMGWFRQAPGKEREFVGAIMWSGAFTHYADSVKGRFTISRDNAKNTVYLQMNALKPEDTAVYYCAVIPGRGSALPIDVGKSDEYEYWGQGTQVTVSSAAAYPYDVPDYGSHHHHHH

SEQ ID NO: 427 - protein, 146 aa, Artificial Sequence
  Synthetic Sequence
QVQLQESGGGLVQAGDSLRLSCAASGLTFSNYIMGWFRQAPGKEREFVAAITWGGGSTVYADSVEGRFTISRDGTKNTVSLQMNSLQPEDTAVYYCAAAGASGRLRDLKVGQNYDYWGQGTQVTVSSAAAYPYDVPDYGSHHHHHH

SEQ ID NO: 428 - protein, 150 aa, Artificial Sequence
  Synthetic Sequence
QVQLQESGGGLVQAGGSLRLSCAGSGFTLDYYGIGWFRQAPGKEREGVSCISSSDRNTYYADSVKGRFTISGDNAKNTVYLQMNNLKPEDTAVYYCAADGNVWSPPICGSAGPPPGGMDYWGKGTQVTVSSAAAYPYDVPDYGSHHHHHH

SEQ ID NO: 429 - protein, 143 aa, Artificial Sequence
  Synthetic Sequence
QVQLQESGGGLVQAGGSLRLSCVASGHTFSSYTMGWFRQAPGKEREFVAFIDWSGGGTYYANSVKGRFTISRDNAENTVYLQMNNLKPEDTAVYYCAAAQRLGSVTDYTKYDYWGQGTQVTVSSAAAYPYDVPDYGSHHHHHH

SEQ ID NO: 430 - protein, 149 aa, Artificial Sequence
  Synthetic Sequence
QVQLQESGGGLVQAGGSLRLSCAASGRTFSSYVIGWFRQAPGKEREFVAVITWSGDSTYSSDSLKGRFTISRDNAKNTVYLQMNALNPEDTAVYYCAAIPPRAYSGGSYSLKDQSKYEYWGQGTQVTVSSAAAYPYDVPDYGSHHHHHH

SEQ ID NO: 431 - protein, 149 aa, Artificial Sequence
  Synthetic Sequence
QVQLQESGGGLVQAEGSLKLSCISGFAFDGYAIGWFRQAPGKEREGVACISSKDGSTYYADSVKGRFTMSVDKTKNTVYLQMSSLKPEDTAVYYCAADGNVWSPPICSSAGPPPGGMDYWGKGTQVTVSSAAAYPYDVPDYGSHHHHHH

SEQ ID NO: 432 - protein, 139 aa, Artificial Sequence
  Synthetic Sequence
QVQLQESGGGLVQPGGSLTLSCAASGFAFGFFDMTWVRQAPGKGLEWVSGINSIGGSTTYADSVKGRFTISRDNAKNELYLQMNSLKPDDTAVYYCAKSRSSYSNNWRPPGQGTQVTVSSAAAYPYDVPDYGSHHHHHH

SEQ ID NO: 433 - protein, 149 aa, Artificial Sequence
  Synthetic Sequence
QVQLQESGGGLVQARGSLTLSCAASGRTFSNYVIGWFRQAPGEEREFVAVVTWSGDSTYSSDSLKGRFTISRDNAKNTVYLQMNNLNPEDTAVYYCAAMPPRAYTGRSVSLKDQSKYEYWGQGTQVTVSSAAAYPYDVPDYGSHHHHHH

SEQ ID NO: 434 - protein, 139 aa, Artificial Sequence
  Synthetic Sequence
QVQLQESGGGLVQPGGSLRLSCAASGSIFSINVMGWYRQTPGKERELVAKITNFGITSYADSAQGRFTISRGNAKNTVYLQMNSLKPEDTAVYYCNLDTTGWGPPPYQYWGQGTQVTVSSAAAYPYDVPDYGSHHHHHH

SEQ ID NO: 435 - protein, 149 aa, Artificial Sequence
  Synthetic Sequence
QVQLQESGGGLVQAGASLRLSCAASGRTFSNYNVGWFRQAPGKEREFVSFISWISDITYYSDSVKGRFIISRDNAKNMVYLQMNSLKPEDTAVYYCAAHPPDPSRGGEWRLQTPSEYDYWGQGTQVTVSSAAAYPYDVPDYGSHHHHHH

SEQ ID NO: 436 - protein, 143 aa, Artificial Sequence
  Synthetic Sequence
QVQLQESGGGLVQAGGSLRLSCAASGHTFSSYTMGWFRQAPGKEREFVAFIDWSGGGTYYADSVKGRFTISRDNAENTVYLQMNNLKPEDTAVYYCAAAQRLGSVTDYTKYDYWGQGTQVTVSSAAAYPYDVPDYGSHHHHHH

SEQ ID NO: 437 - protein, 151 aa, Artificial Sequence
  Synthetic Sequence
QVQLQESGGGLVQAGGSLRLSCAASGRTFSTYPVGWFRQAPGKEREFVAVILWSGVSTYYADSVKGRFTISRDNAQNTVYLQMDSLKPEDTAVYYCAVPRSHFTTAQDMGQDMGAPSWYEYWGQGTQVTVSSAAAYPYDVPDYGSHHHHHH

SEQ ID NO: 438 - protein, 149 aa, Artificial Sequence
  Synthetic Sequence
QVQLQESGGGLVQAGGSLRLSCAASGRTFSNYAMGWFRQAPGKEREFVAAIVWSGGSTYYADSVKGRFTISRDNAKNTVYLQMNSLKPEDTAVYYCAAVLIRYYSGGYQGLSDANEYDYWGQGTQVTVSSAAAYPYDVPDYGSHHHHHH

SEQ ID NO: 439 - protein, 144 aa, Artificial Sequence
  Synthetic Sequence
QVQLQESGGGLVQAGASLRLSCSASGRTFSDYRMGWFRQAPGKEREWVAAISSSGYHTYYADSVKGRFTISRDNAKNTGYLQMSSLKPEDTAVYYCAVVKYLSGSYSYAGQYNFWGQGTQVTVSSAAAYPYDVPDYGSHHHHHH

SEQ ID NO: 440 - protein, 150 aa, Artificial Sequence
  Synthetic Sequence
QVQLQESGGGLVQAGDSLKLSCAASGLTFSNYIMAWFRQAPGKEREGVSCISSPDGSTYYADSVKGRFTISSDNAKNTVYLQMNSLKPEDTAVYYCAADFNVWSPPICGSVGPPPGGMDYWGKGTQVTVSSAAAYPYDVPDYGSHHHHHH

SEQ ID NO: 441 - protein, 148 aa, Artificial Sequence
  Synthetic Sequence
QVQLQESGGGLVQAGGSLRLSCAASGRTFSNSVMGWFRQPPGKEREFVAAVLWSGVSTAYADSVKGRFTISRDNAKNTVYLQMNNLKPDDTAVYYCAAHESTYYSGTYYLTDPRRYVYWGQGTQVTVSSAAAYPYDVPDYGSHHHHHH

SEQ ID NO: 442 - protein, 146 aa, Artificial Sequence
  Synthetic Sequence
QVQLQESGGGLVQAGGSLRLSCVGDGRTFSSYIIGWFRQAPGNEREFVVAITWDGSATTYADSVKGRFTVSRDSAKNTAYLQMNSLKPEDTAVYYCAAVPARGLTMDLENSDIYDHWGRGTQVTVSSAAAYPYDVPDYGSHHHHHH

SEQ ID NO: 443 - protein, 149 aa, Artificial Sequence
  Synthetic Sequence
QVQLQESGGGLVQAGGSLRLSCAASGRTFSSYVMGWFRQALGKEREFVAAIGWNGGITYYADSVKGRFAISRDNAKNTVYLQMNSLKPEDTAVYYCAAATLQVTGSYYLDLSTVDIYDNWGQGTQVTVSSAAAYPYDVPDYGSHHHHHH

SEQ ID NO: 444 - protein, 147 aa, Artificial Sequence
  Synthetic Sequence
QVQLQESGGGLVQAGGSLRLSCAASGGTFSNYVMGWFRQAPGKEREFVGFITWSGASTYYADSVKGRFTISRDNAENTVYLQMNSLKPEDTAVYYCAATLFRSNGPKDLSSGYEYDYWGQGTQVTVSSAAAYPYDVPDYGSHHHHHH

SEQ ID NO: 445 - protein, 140 aa, Artificial Sequence
  Synthetic Sequence
  misc_feature (112)..(112): Xaa can be any naturally occurring amino acid
QVQLQESGGGLVQAGDSLRLTCTASGRTFSNYGIGWFRQAPGKEREFVAGINWSGESADYADSVKGRFTISRDNAKNTVYLQMNSLKPEDTAVYYCAAGESGVWVGGLDYWXQGTQVTVSSAAAYPYDVPDYGSHHHHHH

SEQ ID NO: 446 - protein, 149 aa, Artificial Sequence
  Synthetic Sequence
QVQLQESGGGLVQAGGSLRLSCAASGFTFDDYAIAWFRQAPGKEREGVSCIERSDGSTYYADSVKGRFTISSDNAKNTVYLQMNSLKPEDTAVYYCAVGSANSGEFRFGWVLKPDLYNYWGQGTQVTVSSAAAYPYDVPDYGSHHHHHH

SEQ ID NO: 447 - protein, 150 aa, Artificial Sequence
  Synthetic Sequence
QVQLQESGGGLVQAGGSLRLSCTASGRTFSSYTVAWFRQSPGKEREGISCISNTDSSTYYADSVKGRFTISSDNAKSTVHLQMSSLKPEDTAVYYCAADGNVWSPPICGSAGPPPGGMDYWGKGTQVTVSSAAAYPYDVPDYGSHHHHHH

SEQ ID NO: 448 - protein, 150 aa, Artificial Sequence
  Synthetic Sequence
QVQLQESGGGLVQPGGSLRLSCATFGFPFDDYAIAWFRQAPGKEREGVSCISNTDSSTYYADSVKGRFTISSDNAKNTVHLQMSSLKPEDTAVYYCAADGNVWSPPICGSAGPPPGGMDYWGKGTQVTVSSAAAYPYDVPDYGSHHHHHH

SEQ ID NO: 449 - protein, 147 aa, Artificial Sequence
  Synthetic Sequence
QVQLQESGGGLVQAGGSLRLSCAASGRTFSSYVMGWFRQAPGKEREFVAQISWSAGSIYYADSVKGRFTISNDNAKRTVYLQMNSLKPEDTAVYYCAERGYAYCSDDGCQRTQDYDYWGQGTQVTVSSAAAYPYDVPDYGSHHHHHH

SEQ ID NO: 450 - protein, 148 aa, Artificial Sequence
  Synthetic Sequence
QVQLQESGGGLVQAGGSLRLSCAASGRTLSSNPMAWFRQAAGKEREFVAGMSWNPGPAVYADSVKGRFTISRDSAENTVYLQMNSLKPEDTAVYYCAGAARAWWSGSYDYTRMNNYDYWGPGTQVTVSSAAAYPYDVPDYGSHHHHHH

SEQ ID NO: 451 - protein, 150 aa, Artificial Sequence
  Synthetic Sequence
QVQLQESGGGLVQAGGSLRLSCAVSGFTFDNYAIGWFRQAPGKEREGVSCISRSDGSTYYADSVRGRFTISSDNAKNTVYLQMNSLKPEDTAVYYCAAETSADSGEFRFGWVLKPSLYDYWGQGTQVTVSSAAAYPYDVPDYGSHHHHHH

SEQ ID NO: 452 - protein, 148 aa, Artificial Sequence
  Synthetic Sequence
QVQLQESGGGLVQAGGSLRLSCAASGRAFSSYFMGWFRQTPGKEREFVANIGWTGDMTYYADSVKGRFTISRDNAKNTVYLQMNSLKPEDTAVYYCAAAGSAYSGSYWNITMAANYDYWGQGTQVTVSSAAAYPYDVPDYGSHHHHHH

SEQ ID NO: 453 - protein, 145 aa, Artificial Sequence
  Synthetic Sequence
QVQLQESGGGLVQAGGSLRLSCAASTPTFSSYNMGWFRQAPGKEREFVAAIIWSGSMTYYADSMKGRFTVSIDNAKNTVYLQMNSLKPEDTAVYYCAAQRIFGAQPMDLSGDYEYWGQGTQVTVSSAAAYPYDVPDYGSHHHHHH

SEQ ID NO: 454 - protein, 150 aa, Artificial Sequence
  Synthetic Sequence
QVQLQESGGGLVQAGGSLRLSCATFGFTFDDYAIAWFRQAPGKEREGISCISNTDSSTYYADSVKGRFTISSDSAKNTVHLQMSSLKPEDTAVYYCAADGNVWSPPICGSAGPPPGGMDYWGKGTQVTVSSAAAYPYDVPDYGSHHHHHH

SEQ ID NO: 455 - protein, 145 aa, Artificial Sequence
  Synthetic Sequence
QVQLQESGGGLVQAGGSLRLSCKASGGTFSGYIMGWFRQAPGKEREFVAANTWSGGPTYYSDSVKGRFTISRDNAKNTVYLQMNTLKPEDTAVYQCAARDYRGIKDLDLKGDYDYWGQGTQVTVSSAAAYPYDVPDYGSHHHHHH

SEQ ID NO: 456 - protein, 151 aa, Artificial Sequence
  Synthetic Sequence
QVQLQESGGGLVQAGDSLKLSCATSGRSFSSYTIAWFRQAPGKEREGISCISSDGSTGYADSVRGRFTISSDNAKNTVYLQMNSLKPEDTAVYYCAADFNVWSPPICGSIWYGPPPRGMDYWGKGTQVTVSSAAAYPYDVPDYGSHHHHHH

SEQ ID NO: 457 - protein, 152 aa, Artificial Sequence
  Synthetic Sequence
QVQLQESGGGLVQAGGYLRLSCAASGFSSDDYTIGWFRQAPGKEREGISCYSSSDGSTGFADSVKGRFTISSDNAKNTVYLQMNNLRPEDTAVYYCAADSNVWSPPICGSRWYGPPPGGMAYWGKGTQVTVSSAAAYPYDVPDYGSHHHHHH

SEQ ID NO: 458 - protein, 151 aa, Artificial Sequence
  Synthetic Sequence
QVQLQESGGGLAQVGGSLRLSCTASGFTFDDYTIGWFRQAPGKEREGISCISSDGSTGYADSVKGRFTISSDNAKNTVYLQMNSLKPEDTAVYYCAADFNVWSPPICGSNWYGPPPGGMDYWGKGTQVTVSSAAAYPYDVPDYGSHHHHHH

SEQ ID NO: 459 - protein, 152 aa, Artificial Sequence
  Synthetic Sequence
QVQLQESGGGLVQAGGSLRLSCAASGFSSDDYTIGWFRQAPGKEREGIGCIKSSDGTTGYADSVKGRFTISSDNAKNTVYLQMNSLKPEDTAVYYCAADFNVWSPPICGSIWYGPPPGGMDYWGKGTQVTVSSAAAYPYDVPDYGSHHHHHH

SEQ ID NO: 460 - protein, 150 aa, Artificial Sequence
  Synthetic Sequence
QVQLQESGGGLAQAGGSLRLSCAASGFTFDQYTIAWFRQAPGKEREGVSCISNTDSSTYYADSVKGRFTISSDNAKNTVYLQMSSLKPEDTAVYYCAADGNVWSPPICGSAGPPPGGMDYWGKGTQVTVSSAAAYPYDVPDYGSHHHHHH

SEQ ID NO: 461 - protein, 144 aa, Artificial Sequence
  Synthetic Sequence
QVQLQESGGGLVQAGGSLRLSCAASGRTFSSYAMAWFRQAPGKEREFVAAIAWSAGSTYYADSVKGRFAISRDNAENTVYLQMNSLKPEDTAVYYCAARIITVATMRLDSDYDYWGQGTQVTVSSAAAYPYDVPDYGSHHHHHH

SEQ ID NO: 462 - protein, 150 aa, Artificial Sequence
  Synthetic Sequence
QVQLQESGGGLVQAGGSLRLSCAASGFAFDGYAIGWFRQAPGKEREGVSCISSKEGSTYYADSVKGRFTISSDNAKNTVYLQMSSLKPEDTAVYYCAADGNVWSPPICGSAGPPPGGMDYWGKGTQVTVSSAAAYPYDVPDYGSHHHHHH

SEQ ID NO: 463 - protein, 152 aa, Artificial Sequence
  Synthetic Sequence
QVQLQESGGGLVQAGGSLRLSCAASGFSSDDYTIAWFRRAPGKEREGISCISSSDGSTGYADSVKGRFTITSDSAKNTVYLQMNSLKPEDTAVYYCAADSNVWSPPICGRTWYGPPPGGMDYWGKGTQVTVSSAAAYPYDVPDYGSHHHHHH

SEQ ID NO: 464 - protein, 152 aa, Artificial Sequence
  Synthetic Sequence
QVQLQESGGGLVQPGGSLRLSCAASGFSSDDYTIGWFRQAPGKEREGISCYSSRDGTTGYADSVKGRFTISSDNAKNTVYLQMNSLKPEDTAVYYCAADFNVWSPPICGSIWYGPPPGGMAYWGQGTQVTVSSAAAYPYDVPDYGSHHHHHH

SEQ ID NO: 465 - protein, 151 aa, Artificial Sequence
  Synthetic Sequence
QVQLQESGGGLVQAGGSLRLSCAASGFTFDDYTIGWFRQAPGKEREGISCISSDGSTGYADSVKGRFTISSDNAKNTVYLQMNSLKPEDTAVYYCAADFNVWSPPICGSNWYGPPPGGMDYWGKGTQVTVSSAAAYPYDVPDYGSHHHHHH

SEQ ID NO: 466 - protein, 152 aa, Artificial Sequence
  Synthetic Sequence
QVQLQESGGGLVQAGGSLRLSCAASGFSSDDYTIGWFRQAPGKEREGISCYSSSDGSTGYADSVKGRFTISSDNAKNTVYLQMNSLKPEDTAVYYCAADFNVWSPPICGSSWYGPPPGGMDYWGKGTQVTVSSAAAYPYDVPDYGSHHHHHH

SEQ ID NO: 467 - protein, 152 aa, Artificial Sequence
  Synthetic Sequence
QVQLQESGGGLVQAGGSLRLSCAASGFSSDDYTIGWFRQAPGKEREGISCFSSSDGSTGFADSVKGRFTISSDNATNTVYLEMNSLKPEDTAVYYCAADFNVWSPPICGSRWYGPPPGGMEYWGKGTQVTVSSAAAYPYDVPDYGSHHHHHH

SEQ ID NO: 468 - protein, 150 aa, Artificial Sequence
  Synthetic Sequence
QVQLQESGGGLVQAGGSLRLSCATFGFSFDDYAIAWFRQAPGKEREGISCISNTDSSTFYADSVKGRFTISSDNAKNTVHLQMSSLKPEDTAVYYCAADGNVWSPPICGSAGPPPGGMDYWGKGTQVTVSSAAAYPYDVPDYGSHHHHHH

SEQ ID NO: 469 - protein, 152 aa, Artificial Sequence
  Synthetic Sequence
QVQLQESGGGLVQAGGSLRLSCAASGFSSDDYTIGWFRQAPGKEREGISCYSSSDGSTGFADSVKGRFTISSDNAKNTVYLQMNSLRPEDTAVYYCAADFNVWSPPICGSRWYGPPPGGMAYWGKGTQVTVSSAAAYPYDVPDYGSHHHHHH

SEQ ID NO: 470 - protein, 151 aa, Artificial Sequence
  Synthetic Sequence
QVQLQESGGGLVQVGGSLRLSCTISGFTGNDLAIGWFRQAPGKDQREGISCISNTDSSTYYADSVKGRFTISSDNAKNTVHLQMSSLKPEDTAVYYCAADGNVWSPPICGSAGPPPGGMDYWGKGTQVTVSSAAAYPYDVPDYGSHHHHHH

SEQ ID NO: 471 - protein, 152 aa, Artificial Sequence
  Synthetic Sequence
QVQLQESGGGLVQAGGSLRLSCAASGFSSDDYTIAWFRRAPGKEREGISCISSSDGSTGYADSVKGRFTISSDNAKNTVYLQMTSLKPEDTAVYYCAADSNVWSPPICGKTWYGPPPGGMDYWGKGTQVTVSSAAAYPYDVPDYGSHHHHHH

SEQ ID NO: 472 - protein, 140 aa, Artificial Sequence
  Synthetic Sequence
QVQLQESGGGLVQAGDSLRLSCAGSEGTLSSYGIGWFRQAPGKEREFVGGINWSGDSTDYADSVKGRFTISRDSAKNTVYLQMNSLKPEDTAVYYCAAGESGVWVGGLDYWGQGTQVTVSSAAAYPYDVPDYGSHHHHHH

SEQ ID NO: 473 - protein, 152 aa, Artificial Sequence
  Synthetic Sequence
QVQLQESGGGLVQAGGSLRLSCAASGFSSDDYTIAWFRRAPGKEREGISCFSSSDGSAGYADSVKGRFTVSSDNAKNTVYLQMNSLKPEDTAVYYCAADSNVWSPPICGSTWYGPPPGGMAYWGKGTQVTVSSAAAYPYDVPDYGSHHHHHH

SEQ ID NO: 474 - protein, 150 aa, Artificial Sequence
  Synthetic Sequence
QVQLQESGGGLVQAGGSLRLSCATSGFTFDDYAIAWFRQAPGKEREGVSCISNTDSSTYYADSVKGRFTISSDNAKNTVYLQMSSLKPEDTAVYYCAADGNVWSPPICGSAGPPPGGMDYWGKGTQVTVSSAAAYPYDVPDYGSHHHHHH

SEQ ID NO: 475 - protein, 152 aa, Artificial Sequence
  Synthetic Sequence
QVQLQESGGGLVQAGGSLRLSCEVSGLSSDDYTIGWFRQAPGKEREGFSCFSTRDGNAGYADSVKGRFTISSDNAKNTVYLQMNNLKPEDTAVYYCAADFNVWSPPICGSRWYGPPPGGMDYWGKGTQVTVSSAAAYPYDVPDYGSHHHHHH

SEQ ID NO: 476 - protein, 152 aa, Artificial Sequence
  Synthetic Sequence
QVQLQESGGGLVQAGGSLRLSCEVSGLSSDDYTIGWFRQAPGKKREGFSCFSSRDGSTGYADSVKGRFTISSDNAKNTVYLQMNSLKPEDTAVYYCAADFNVWSPPICGSRWYGPPPGGMDYWGKGTQVTVSSAAAYPYDVPDYGSHHHHHH

SEQ ID NO: 477 - protein, 152 aa, Artificial Sequence
  Synthetic Sequence
QVQLQESGGGLVQAGGSLRLSCAASGFSSDDYTIGWFRQAPGKEREGFSCFSSRDGSTGYADSVKGRFTISSDNAKNTVYLQMNSLKPEDTAVYYCAADFNVWSPPICGSRWYGPPPGGMDYWGKGTQVTVSSAAAYPYDVPDYGSHHHHHH

SEQ ID NO: 478 - protein, 151 aa, Artificial Sequence
  Synthetic Sequence
QVQLQESGGGLVQAGGSLRLSCAASGFSFDDYTIGWFRQVPGKEREGISCISSDGSTGYADSVKGRFTISSDNAKNTVYLQINSLKPEDTAVYYCAADFNVWSPPICGSIWYGPPPGGMDYWGKGTQVTVSSAAAYPYDVPDYGSHHHHHH

SEQ ID NO: 479 - protein, 150 aa, Artificial Sequence
  Synthetic Sequence
QVQLQESGGGLVQAGGSLRLSCATFGFTFDDYAIAWFRQAPGKEREGISCISNTDSSTYYADSVKGRFTISSDNAKNTVHLQMSSLKPEDTAVYYCAADGNVWSPPICGSAGPPPGGMDYWGKGTQVTVSSAAAYPYDVPDYGSHHHHHH

SEQ ID NO: 480 - protein, 150 aa, Artificial Sequence
  Synthetic Sequence
  misc_feature (19)..(19): Xaa can be any naturally occurring amino acid
QVQLQESGGGLVQAGGSLXLSCAASGFTFDDYAIGWFRQAPGKEREGVSCISSPDGSTYYADSVKGRFTISSDNAKNTVYLQMNSLKPEDTAVYYCAADFNVWSPPICGSVGPPPGGMDYWGKGTQVTVSSAAAYPYDVPDYGSHHHHHH

SEQ ID NO: 481 - protein, 152 aa, Artificial Sequence
  Synthetic Sequence
QVQLQESGGGLVQAGASLRLSCKASGFTFGDYTIGWFRQAPGKEREGISCYSSSDGNTGYADSVKGRFTISSDNAKNTVYLQMNSLRPEDTAVYYCAADFNVWSPPICGSSWYGPPPGGMAYWGKGTQVTVSSAAAYPYDVPDYGSHHHHHH

SEQ ID NO: 482 - protein, 140 aa, Artificial Sequence
  Synthetic Sequence
QVQLQESGGGLVQAGDSLRLSCAGSEGTFSSYGIGWFRQAPGKEREFVGGINWSGDSTDYADSVKGRFTISRDNAKNTVYLQMNSLKPEDTAVYYCAAGESGVWVGGLDYWGQGTQVTVSSAAAYPYDVPDYGSHHHHHH

SEQ ID NO: 483 - protein, 152 aa, Artificial Sequence
  Synthetic Sequence
QVQLQESGGGLVQAGGSLRLSCAASGFSSDDYTIGWFRQAPGKEREGISCFSSSDGSTGFADSVKGRFTISSDNATNTVYLQMNSLKPEDTAVYYCAADFNVWSPPICGSSWYGPPPGGMEYWGKGTQVTVSSAAAYPYDVPDYGSHHHHHH

SEQ ID NO: 484 - protein, 150 aa, Artificial Sequence
  Synthetic Sequence
QVQLQESGGGLVQAGDSLRLSCTASGVSIGDYNIGWFRQAPGKEREGVSCISSGDGTTYYTDSVKGRFTISTDNAKNTVYLQMNSLKPEDTAVYYCAADGNVWSPPICGSAGPPPGGMDYWGKGTQVTVSSAAAYPYDVPDYGSHHHHHH

SEQ ID NO: 485 - protein, 152 aa, Artificial Sequence
  Synthetic Sequence
QVQLQESGGGLVQAGGSLRLSCAASGFTFDDYTIAWFRQAPGGKEREGISCISSDGSTGYADSVKGRFTISSDNAKNMVYLQMNSLKPEDTALYYCAADFNVWSPPICSSNWYGPPPRGMDYWGKGTQVTVSSAAAYPYDVPDYGSHHHHHH

SEQ ID NO: 486 - protein, 151 aa, Artificial Sequence
  Synthetic Sequence
QVQLQESGGGLVQAGGSLRLSCAASGFTFDDYTIAWFRQAPGKEREGISCISSDGSTGYADSVRGRFTISSDNAKNTVYLQMNSLKPEDTAVYYCAADFNVWSPPICGSIWYGPPPRGMDYWGKGTQVTVSSAAAYPYDVPDYGSHHHHHH

SEQ ID NO: 487 - protein, 10 aa, Artificial Sequence
  Synthetic Sequence
GSISSINVMG

SEQ ID NO: 488 - protein, 10 aa, Artificial Sequence
  Synthetic Sequence
GSFSSINVMG

SEQ ID NO: 489 - protein, 10 aa, Artificial Sequence
  Synthetic Sequence
GSISSINIMG

SEQ ID NO: 490 - protein, 10 aa, Artificial Sequence
  Synthetic Sequence
VSIFSINAMG

SEQ ID NO: 491 - protein, 10 aa, Artificial Sequence
  Synthetic Sequence
GSIFSLNAMG

SEQ ID NO: 492 - protein, 10 aa, Artificial Sequence
  Synthetic Sequence
GRTISNYDMA

SEQ ID NO: 493 - protein, 10 aa, Artificial Sequence
  Synthetic Sequence
GRTFTTSLMQ

SEQ ID NO: 494 - protein, 10 aa, Artificial Sequence
  Synthetic Sequence
ERNLRIYDMA

SEQ ID NO: 495 - protein, 10 aa, Artificial Sequence
  Synthetic Sequence
ERNLRSYDMA

SEQ ID NO: 496 - protein, 10 aa, Artificial Sequence
  Synthetic Sequence
GLTFSNYHMG

SEQ ID NO: 497 - protein, 10 aa, Artificial Sequence
  Synthetic Sequence
GLTFSSYHMG

SEQ ID NO: 498 - protein, 10 aa, Artificial Sequence
  Synthetic Sequence
GLTFSRYHMG

SEQ ID NO: 499 - protein, 10 aa, Artificial Sequence
  Synthetic Sequence
GLTLSSYYIA

SEQ ID NO: 500 - protein, 10 aa, Artificial Sequence
  Synthetic Sequence
GLTFSSYYTG

SEQ ID NO: 501 - protein, 10 aa, Artificial Sequence
  Synthetic Sequence
GLTLSSYHMG

SEQ ID NO: 502 - protein, 10 aa, Artificial Sequence
  Synthetic Sequence
GRTSSPYVTG

SEQ ID NO: 503 - protein, 10 aa, Artificial Sequence
  Synthetic Sequence
GFTFSGYVMS

SEQ ID NO: 504 - protein, 10 aa, Artificial Sequence
  Synthetic Sequence
GFTFSGYVMT

SEQ ID NO: 505 - protein, 10 aa, Artificial Sequence
  Synthetic Sequence
GFTFSGYLMS

SEQ ID NO: 506 - protein, 16 aa, Artificial Sequence
  Synthetic Sequence
RITNLGLPNYADWLKD

SEQ ID NO: 507 - protein, 16 aa, Artificial Sequence
  Synthetic Sequence
RITNLGLPNYADSVTG

SEQ ID NO: 508 - protein, 16 aa, Artificial Sequence
  Synthetic Sequence
RITNIGLPNYADSVKG

SEQ ID NO: 509 - protein, 16 aa, Artificial Sequence
  Synthetic Sequence
RITNLGLPNYADSVEG

SEQ ID NO: 510 - protein, 16 aa, Artificial Sequence
  Synthetic Sequence
AITSGGRVVYSDSVKG

SEQ ID NO: 511 - protein, 16 aa, Artificial Sequence
  Synthetic Sequence
AITSGGRTAYADSVKG

SEQ ID NO: 512 - protein, 16 aa, Artificial Sequence
  Synthetic Sequence
HITSDGRIVYADPVKG

SEQ ID NO: 513 - protein, 17 aa, Artificial Sequence
  Synthetic Sequence
RISGSGDRTDYADSVKG

SEQ ID NO: 514 - protein, 17 aa, Artificial Sequence
  Synthetic Sequence
SITWSTGNTHYADSVKG

SEQ ID NO: 515 - protein, 17 aa, Artificial Sequence
  Synthetic Sequence
VISSSGDSTHYSDFVKG

SEQ ID NO: 516 - protein, 17 aa, Artificial Sequence
  Synthetic Sequence
VITSSGDSTHYSDFVKG

SEQ ID NO: 517 - protein, 17 aa, Artificial Sequence
  Synthetic Sequence
QITWSDASIYYAGSVKG

SEQ ID NO: 518 - protein, 17 aa, Artificial Sequence
  Synthetic Sequence
QITWSDTSIYYAGSVKG

SEQ ID NO: 519 - protein, 17 aa, Artificial Sequence
  Synthetic Sequence
QITWSDGTTYYPGSVKG

SEQ ID NO: 520 - protein, 17 aa, Artificial Sequence
  Synthetic Sequence
QIRWSDDSTYYPGSVKG

SEQ ID NO: 521 - protein, 17 aa, Artificial Sequence
  Synthetic Sequence
QISWSDDSTYYADSVKG

SEQ ID NO: 522 - protein, 16 aa, Artificial Sequence
  Synthetic Sequence
TVSWGGVTYYADSVKG

SEQ ID NO: 523 - protein, 17 aa, Artificial Sequence
  Synthetic Sequence
SIGSGGGYPSYTDSVEG

SEQ ID NO: 524 - protein, 17 aa, Artificial Sequence
  Synthetic Sequence
SIGSGGGYPSYTGSVEG

SEQ ID NO: 525 - protein, 17 aa, Artificial Sequence
  Synthetic Sequence
HIGSGGGYPSYTDSVQG

SEQ ID NO: 526 - protein, 17 aa, Artificial Sequence
  Synthetic Sequence
HIGSGGGHATYTDSVEG

SEQ ID NO: 527 - protein, 17 aa, Artificial Sequence
  Synthetic Sequence
TIGSGGGITSYADSVKG

SEQ ID NO: 528 - protein, 7 aa, Artificial Sequence
  Synthetic Sequence
VALSAEY

SEQ ID NO: 529 - protein, 7 aa, Artificial Sequence
  Synthetic Sequence
VALKAEY

SEQ ID NO: 530 - protein, 7 aa, Artificial Sequence
  Synthetic Sequence
VGLKAEY

SEQ ID NO: 531 - protein, 13 aa, Artificial Sequence
  Synthetic Sequence
KTKSAVLFGGMDY

SEQ ID NO: 532 - protein, 7 aa, Artificial Sequence
  Synthetic Sequence
YIRGEDY

SEQ ID NO: 533 - protein, 7 aa, Artificial Sequence
  Synthetic Sequence
KHYASNY

SEQ ID NO: 534 - protein, 8 aa, Artificial Sequence
  Synthetic Sequence
QDFGSPSF

SEQ ID NO: 535 - protein, 8 aa, Artificial Sequence
  Synthetic Sequence
QDFRSPDF

SEQ ID NO: 536 - protein, 8 aa, Artificial Sequence
  Synthetic Sequence
QIFGSPNF

SEQ ID NO: 537 - protein, 7 aa, Artificial Sequence
  Synthetic Sequence
LAIHGDY

SEQ ID NO: 538 - protein, 7 aa, Artificial Sequence
  Synthetic Sequence
NQIRQWP

SEQ ID NO: 539 - protein, 7 aa, Artificial Sequence
  Synthetic Sequence
NSIRQWP

SEQ ID NO: 540 - protein, 7 aa, Artificial Sequence
  Synthetic Sequence
NAIRQWP

SEQ ID NO: 541 - protein, 8 aa, Artificial Sequence
  Synthetic Sequence
RKVGGPDY

SEQ ID NO: 542 - protein, 7 aa, Artificial Sequence
  Synthetic Sequence
NTFGNVY

SEQ ID NO: 543 - protein, 115 aa, Artificial Sequence
  Synthetic Sequence
QVQLVESGGGLVHPGGSLRLSCAASGSISSINVMGWYRQAPGKERELVARITNLGLPNYADWLKDRFTISRDNAKNTVYLQMNSLKPEDTAVYYCYLVALSAEYWGQGTQVTVSS

SEQ ID NO: 544 - protein, 115 aa, Artificial Sequence
  Synthetic Sequence
QVQLVESGGGLVHPGGSLRLSCAASGSFSSINVMGWYRQAPGKERELVARITNLGLPNYADSVTGRFTISRDNAKNTVYLQMNSLKPEDTAVYYCYLVALKAEYWGQGTQVTVSS

SEQ ID NO: 545 - protein, 115 aa, Artificial Sequence
  Synthetic Sequence
QVQLVESGGGLVHRGGSLRLSCAASGSISSINIMGWYRQAPGKERELVARITNIGLPNYADSVKGRFTISRDNAKSTVYLQMNSLNAEDTAVYYCYLVALKAEYWGQGTQVTVSS

SEQ ID NO: 546 - protein, 115 aa, Artificial Sequence
  Synthetic Sequence
QVQLVESGGGLVQPGGSLRLSCAASGSISSINVMGWYRQAPGKERELVARITNLGLPNYADSVEGRFTISRDKDENTVYLEMNTLKPEDTAVYYCYLVGLKAEYWGQGTQVTVSS

SEQ ID NO: 547 - protein, 121 aa, Artificial Sequence
  Synthetic Sequence
QVQLVESGGGLVQPGGSLRLSCAASGSSDSINAMGWYRQAPGKERELVAAITSGGRVVYSDSVKGRGTISRDNAKNTVYLQIASLKPEDTAVYYCNVKTKSAVLFGGMDYWGKGTQVTVSS

SEQ ID NO: 548 - protein, 115 aa, Artificial Sequence
  Synthetic Sequence
QVQLVESGGGLVQPGGSLRLSCAASVSIFSINAMGWYRQAPGKERELVAAITSGGRTAYADSVKGRFTISRDNSKNTVYLQMDSLKPEDTDVYYCKAYIRGEDYWGKGTQVTVSS

SEQ ID NO: 549 - protein, 115 aa, Artificial Sequence
  Synthetic Sequence
DVQLVESGGGLVQPGGSLRLSCAASGSIFSLNAMGWYRQAPGKERELVAHITSDGRIVYADPVKGRFTISRVDGKNMVTLQMNSLKPEDTAVYYCNAKHYASNYWGQGTQVTVSS

SEQ ID NO: 550 - protein, 117 aa, Artificial Sequence
  Synthetic Sequence
QVQLVESGGGSVQAGGSLRLSCAASGRTISNYDMAWSRQAPGKEREFVARISGSGDRTDYADSVKGRFTISRDNAKNTVYLQMNSLKPEDTAIYYCQIQDFGSPSFSGQGTQVTVSS

SEQ ID NO: 551 - protein, 117 aa, Artificial Sequence
  Synthetic Sequence
DVQLVESGGGSVQAGGSLRLSCAASGRTISNYDMAWSRQAPGKEREFVARISGSGDRTDYADSVKGRFTISRDNAKNTVYLQMNSLKPEDTAIYYCQIQDFRSPDFWSQGTQVTVSS

SEQ ID NO: 552 - protein, 117 aa, Artificial Sequence
  Synthetic Sequence
QVQLVESGGESVQAGGSLRLSCAASGRTISNYDMAWSRQAPGKEREFVARISGSGDRTDYADSVKGRFTISRDNAKNTVYLQMNSLKPEDTAIYNCQTQIFGSPNFSGQGTQVTVSS

SEQ ID NO: 553 - protein, 116 aa, Artificial Sequence
  Synthetic Sequence
QVQLVESGGGLVQAGDSLRLSCAASGRTFTTSLMQWHRQAPGKEREFVASITWSTGNTHYADSVKGRFTISRDNARNTVYLQMNSLKPEDTAIYTCRVLAIHGDYWGQGTQVTVSS

SEQ ID NO: 554 - protein, 116 aa, Artificial Sequence
  Synthetic Sequence
DVQLVESGGGLVQAGDSLRLSCAASERNLRIYDMAWYRQAPGKEREYVAVISSSGDSTHYSDFVKGRFTISRDNAKNTVSLQMDSLKPEDTAFYYCNVNQIRQWPWGQGTQVTVSS

SEQ ID NO: 555 - protein, 116 aa, Artificial Sequence
  Synthetic Sequence
QVQLVESGGGLVQAGDSLRLSCAASERNLRIYDMAWYRQAPGKEREYVAVISSSGDSTHYSDFVKGRFTISRDNAKNTVSLQMDSLKPEDTAFYYCNVNSIRQWPWGQGTQVTVSS

SEQ ID NO: 556 - protein, 116 aa, Artificial Sequence
  Synthetic Sequence
QVQLVESGGGLVQAGDSLRLSCTASERNLRSYDMAWWRQAPGKEREYVAVITSSGDSTHYSDFVKGRFTISRDNAKNTVSLQMDSLKPEDTASYYCNVNAIRQWPWGQGTQVTVSS

SEQ ID NO: 557 - protein, 117 aa, Artificial Sequence
  Synthetic Sequence
DVQLVESGGGSVQAGGSLRLSCAISGLTFSNYHMGWYRQAPGREREFVAQITWSDASIYYAGSVKGRFTISRDNVKNIVYLQIDNLKPEDTAIYYCDARKVGGPDYWGQGTQVTVSS

SEQ ID NO: 558 - protein, 117 aa, Artificial Sequence
  Synthetic Sequence
QVQLVESGGGLVQAGGSLTLSCAISGLTFSSYHMGWYRQAPGREREFVAQITWSDTSIYYAGSVKGRFTISRDNVKNIVYLQIDNLKPEDTAIYYCDARKVGGPDYWGQGTQVTVSS

SEQ ID NO: 559 - protein, 117 aa, Artificial Sequence
  Synthetic Sequence
DVQLVESGGGLVQAGGSLRLSCAISGLTFSRYHMGWYRQAPGREREFVAQITWSDGTTYYPGSVKGRFTISRDNARNTVYLQIDNLKPEDTAIYYCDARKVGGPDYWGQGTQVTVSS

SEQ ID NO: 560 - protein, 117 aa, Artificial Sequence
  Synthetic Sequence
QVQLVESGGGLVQAGGSLRLSCATSGLTLSSYYIAWYRQAPGREREFVAQIRWSDDSTYYPGSVKGRFTISRDNARNTVYLRMDNLKPEDTARYYCDARKVGGPDYWGQGTQVTVSS

SEQ ID NO: 561 - protein, 117 aa, Artificial Sequence
  Synthetic Sequence
DVQLVESGGGLVQAGGSLRLSCATSGLTFSSYYTGWYRQAPGREREFVAQISWSDDSTYYADSVKGRFTISRDNARNTVYLQMNNLKPGDTAIYYCDARKVGGPDYWGQGTQVTVSS

SEQ ID NO: 562 - protein, 117 aa, Artificial Sequence
  Synthetic Sequence
DVQLVESGGGLVQAGGSLRLSCATSGLTLSSYHMGWYRQAPGREREFVAQISWSDDSTYYADSVKGRFTISRDNARNTVYLQMNNLKPEDTAIYYCDARKVGGPDYWGQGTQVTVSS

SEQ ID NO: 563 - protein, 115 aa, Artificial Sequence
  Synthetic Sequence
DVQLVESGGGLVQAGGSLRLSCAASGRTSSPYVTGWYRQTPGKEREPVATVSWGGVTYYADSVKGRFTISRDNAKNTVYLQMNALKPEDTAIYYCNVNTFGNVYWGQGTQVTVSS

SEQ ID NO: 564 - protein, 112 aa, Artificial Sequence
  Synthetic Sequence
QVQLVESGGGLVQPGGSLRLSCAASGFTFSGYVMSWVRQAPGKGLEWVASIGSGGGYPSYTDSVEGRFTISRDNAKNTLYLLMDNLKPDDTAVYYCEMLGRRGQGTQVTVSS

SEQ ID NO: 565 - protein, 112 aa, Artificial Sequence
  Synthetic Sequence
QVQLVESGGGLVQPGGSLRLSCAASGFTFSGYVMSWVRQAPGKGLEWVASIGSGGGYPSYTDSVEGRFTISRDNAKNTLYLQMNNLKPDDTAVYYCEMLGRRGQGTQVTVSS

SEQ ID NO: 566 - protein, 112 aa, Artificial Sequence
  Synthetic Sequence
QVQLVESGGGLVQPGGSLRLSCAASGFTFSGYVMSWVRQAPGKGLEWVASIGSGGGYPSYTGSVEGRFTISRDNAKNTLYLLMNNLKPDDTAVYYCEMLGRRGQGTQVTVSS

SEQ ID NO: 567 - protein, 112 aa, Artificial Sequence
  Synthetic Sequence
QVQLVESGGGLVQPGGSLRLSCAASGFTFSGYVMSWVRQAPGKGLEWVAHIGSGGGYPSYTDSVQGRFTISRDNAKNTLYLQMNNLKPEDTAVYYCEMLGRRGQGTQVTVSS

SEQ ID NO: 568 - protein, 112 aa, Artificial Sequence
  Synthetic Sequence
QVQLVESGGGLVQPGGSLRLSCAASGFTFSGYVMTWVRQAPGKGLEWVAHIGSGGGHATYTDSVEGRFTISRDNAKNTLYLQMNNLKAEDTAVYYCEFLGRRGQGTQVTVSS

SEQ ID NO: 569 - protein, 112 aa, Artificial Sequence
  Synthetic Sequence
QVQLVESGGGLVQPGGSLRLSCAASGFTFSGYLMSWVRQAPGKGLEWVATIGSGGGITSYADSVKGRFTISRDNAKNTLYLQMNNLKHEDTAVYYCETVIKRGQGTQVTVSS

SEQ ID NO: 570 - protein, 10 aa, Artificial Sequence
  Synthetic Sequence
GRISSINSMG

SEQ ID NO: 571 - protein, 10 aa, Artificial Sequence
  Synthetic Sequence
GSITSINAMG

SEQ ID NO: 572 - protein, 10 aa, Artificial Sequence
  Synthetic Sequence
GRFFRVNAMG

SEQ ID NO: 573 - protein, 10 aa, Artificial Sequence
  Synthetic Sequence
GSSDSINAMG

SEQ ID NO: 574 - protein, 10 aa, Artificial Sequence
  Synthetic Sequence
GSVFSINAWG

SEQ ID NO: 575 - protein, 10 aa, Artificial Sequence
  Synthetic Sequence
GSILSINSMG

SEQ ID NO: 576 - protein, 10 aa, Artificial Sequence
  Synthetic Sequence
VSISSINSMG

SEQ ID NO: 577 - protein, 10 aa, Artificial Sequence
  Synthetic Sequence
GRVFSINAMG

SEQ ID NO: 578 - protein, 10 aa, Artificial Sequence
  Synthetic Sequence
VNIDTLNSMA

SEQ ID NO: 579 - protein, 10 aa, Artificial Sequence
  Synthetic Sequence
GGISSINSMG

SEQ ID NO: 580 - protein, 10 aa, Artificial Sequence
  Synthetic Sequence
GSMHSVNSMA

SEQ ID NO: 581 - protein, 10 aa, Artificial Sequence
  Synthetic Sequence
GDISSINAMG

SEQ ID NO: 582 - protein, 10 aa, Artificial Sequence
  Synthetic Sequence
GSIFSIDAMG

SEQ ID NO: 583 - protein, 10 aa, Artificial Sequence
  Synthetic Sequence
GSIFSINAMG

SEQ ID NO: 584 - protein, 10 aa, Artificial Sequence
  Synthetic Sequence
GSIFSIAAMG

SEQ ID NO: 585 - protein, 10 aa, Artificial Sequence
  Synthetic Sequence
GNIASITAMG

SEQ ID NO: 586 - protein, 10 aa, Artificial Sequence
  Synthetic Sequence
GSISSINAMG

SEQ ID NO: 587 - protein, 10 aa, Artificial Sequence
  Synthetic Sequence
VSIFRSYFMG

SEQ ID NO: 588 - protein, 10 aa, Artificial Sequence
  Synthetic Sequence
GSIVSINAIG

SEQ ID NO: 589 - protein, 10 aa, Artificial Sequence
  Synthetic Sequence
RSFSSFNAMG

SEQ ID NO: 590 - protein, 10 aa, Artificial Sequence
  Synthetic Sequence
GSFSSINAMG

SEQ ID NO: 591 - protein, 10 aa, Artificial Sequence
  Synthetic Sequence
GTSFSINGMA

SEQ ID NO: 592 - protein, 10 aa, Artificial Sequence
  Synthetic Sequence
GRTFSTYAMG

SEQ ID NO: 593 - protein, 10 aa, Artificial Sequence
  Synthetic Sequence
GRIFDINAMG

SEQ ID NO: 594 - protein, 10 aa, Artificial Sequence
  Synthetic Sequence
GTLFSINGMA

SEQ ID NO: 595 - protein, 10 aa, Artificial Sequence
  Synthetic Sequence
GSIDSINAMG

SEQ ID NO: 596 - protein, 10 aa, Artificial Sequence
  Synthetic Sequence
GRAFSTNSMG

SEQ ID NO: 597 - protein, 10 aa, Artificial Sequence
  Synthetic Sequence
GSIISINSMG

SEQ ID NO: 598 - protein, 10 aa, Artificial Sequence
  Synthetic Sequence
RNFFSINAMG

SEQ ID NO: 599 - protein, 10 aa, Artificial Sequence
  Synthetic Sequence
GSIVSINSMG

SEQ ID NO: 600 - protein, 10 aa, Artificial Sequence
  Synthetic Sequence
GSIIGINSMG

SEQ ID NO: 601 - protein, 10 aa, Artificial Sequence
  Synthetic Sequence
GRTFPGYVMA

SEQ ID NO: 602 - protein, 10 aa, Artificial Sequence
  Synthetic Sequence
GRTFSINAMG

SEQ ID NO: 603 - protein, 10 aa, Artificial Sequence
  Synthetic Sequence
GRTLSSYTIG

SEQ ID NO: 604 - protein, 10 aa, Artificial Sequence
  Synthetic Sequence
GSFFSINAMG

SEQ ID NO: 605 - protein, 10 aa, Artificial Sequence
  Synthetic Sequence
GSIFSINSMG

SEQ ID NO: 606 - protein, 10 aa, Artificial Sequence
  Synthetic Sequence
GSIFSFNAMG

SEQ ID NO: 607 - protein, 10 aa, Artificial Sequence
  Synthetic Sequence
GRTFSTYAMA

SEQ ID NO: 608 - protein, 10 aa, Artificial Sequence
  Synthetic Sequence
VNIGSLNSMV

SEQ ID NO: 609 - protein, 10 aa, Artificial Sequence
  Synthetic Sequence
GRTLSNYAVG

SEQ ID NO: 610 - protein, 10 aa, Artificial Sequence
  Synthetic Sequence
GSVFSINAMG

SEQ ID NO: 611 - protein, 10 aa, Artificial Sequence
  Synthetic Sequence
GSIFEINSIG

SEQ ID NO: 612 - protein, 10 aa, Artificial Sequence
  Synthetic Sequence
GSIFNINSMG

SEQ ID NO: 613 - protein, 10 aa, Artificial Sequence
  Synthetic Sequence
VNIGTLNSMA

SEQ ID NO: 614 - protein, 10 aa, Artificial Sequence
  Synthetic Sequence
GRIGSINSMG

SEQ ID NO: 615 - protein, 10 aa, Artificial Sequence
  Synthetic Sequence
GRTLSNYAVA

SEQ ID NO: 616 - protein, 10 aa, Artificial Sequence
  Synthetic Sequence
RSFFSFNAMG

SEQ ID NO: 617 - protein, 10 aa, Artificial Sequence
  Synthetic Sequence
GIIFSINAMG

SEQ ID NO: 618 - protein, 10 aa, Artificial Sequence
  Synthetic Sequence
GRIFSVNAMG

SEQ ID NO: 619 - protein, 16 aa, Artificial Sequence
  Synthetic Sequence
AITNGGAKTYADSVKG

SEQ ID NO: 620 - protein, 17 aa, Artificial Sequence
  Synthetic Sequence
AITSGGRLSYADSVKGR

SEQ ID NO: 621 - protein, 16 aa, Artificial Sequence
  Synthetic Sequence
AITNGGQTAYADSVKG

SEQ ID NO: 622 - protein, 16 aa, Artificial Sequence
  Synthetic Sequence
AITSGGRSTYIDSAKG

SEQ ID NO: 623 - protein, 16 aa, Artificial Sequence
  Synthetic Sequence
AITNQGRIAYAPSVNG

SEQ ID NO: 624 - protein, 16 aa, Artificial Sequence
  Synthetic Sequence
AITNDGRTTYVDSVKG

SEQ ID NO: 625 - protein, 16 aa, Artificial Sequence
  Synthetic Sequence
AVTVGGRYAYADSAKN

SEQ ID NO: 626 - protein, 16 aa, Artificial Sequence
  Synthetic Sequence
AITNQGATTYADSVKG

SEQ ID NO: 627 - protein, 16 aa, Artificial Sequence
  Synthetic Sequence
GITGSGQITYANSVRG

SEQ ID NO: 628 - protein, 16 aa, Artificial Sequence
  Synthetic Sequence
AITNGGRTVYGDSVKG

SEQ ID NO: 629 - protein, 16 aa, Artificial Sequence
  Synthetic Sequence
AITSGGRLAYAPSVNG

SEQ ID NO: 630 - protein, 16 aa, Artificial Sequence
  Synthetic Sequence
AITNGGRTTYVDSVKG

SEQ ID NO: 631 - protein, 16 aa, Artificial Sequence
  Synthetic Sequence
AITTGGRTTYVDSVKG

SEQ ID NO: 632 - protein, 16 aa, Artificial Sequence
  Synthetic Sequence
AITNQGRLTYADSVKG

SEQ ID NO: 633 - protein, 16 aa, Artificial Sequence
  Synthetic Sequence
AITSGGRRAYADSVKG

SEQ ID NO: 634 - protein, 18 aa, Artificial Sequence
  Synthetic Sequence
AITSASASRTTYADSVKG

SEQ ID NO: 635 - protein, 17 aa, Artificial Sequence
  Synthetic Sequence
CISRSDGSTYYDDSVKG

SEQ ID NO: 636 - protein, 16 aa, Artificial Sequence
  Synthetic Sequence
AITNQGRVTYADSVKG

SEQ ID NO: 637 - protein, 16 aa, Artificial Sequence
  Synthetic Sequence
AITDGGRLAYADSAKG

SEQ ID NO: 638 - protein, 16 aa, Artificial Sequence
  Synthetic Sequence
SITNQGIRNYSTSVMG

SEQ ID NO: 639 - protein, 16 aa, Artificial Sequence
  Synthetic Sequence
AITNQGRTTYADSVKG

SEQ ID NO: 640 - protein, 16 aa, Artificial Sequence
  Synthetic Sequence
AITNGGRIAYGIAVNG

SEQ ID NO: 641 - protein, 16 aa, Artificial Sequence
  Synthetic Sequence
AITNGGRIAYSDSAKG

SEQ ID NO: 642 - protein, 16 aa, Artificial Sequence
  Synthetic Sequence
GITSDGSTGYADSVKG

SEQ ID NO: 643 - protein, 17 aa, Artificial Sequence
  Synthetic Sequence
AISWSGGSTYYADSVKG

SEQ ID NO: 644 - protein, 16 aa, Artificial Sequence
  Synthetic Sequence
AITDQGRLAYADSAKG

SEQ ID NO: 645 - protein, 16 aa, Artificial Sequence
  Synthetic Sequence
AITNGGQTTYADSVKG

SEQ ID NO: 646 - protein, 16 aa, Artificial Sequence
  Synthetic Sequence
AITTGGRTAYVDSVKG

SEQ ID NO: 647 - protein, 16 aa, Artificial Sequence
  Synthetic Sequence
AITSQGRITLADSVKG

SEQ ID NO: 648 - protein, 16 aa, Artificial Sequence
  Synthetic Sequence
AITVDGRLAYADSAKH

SEQ ID NO: 649 - protein, 16 aa, Artificial Sequence
  Synthetic Sequence
AITNGGRIAYGTSVMG

SEQ ID NO: 650 - protein, 16 aa, Artificial Sequence
  Synthetic Sequence
AITNGGQIAYADSVKG

SEQ ID NO: 651 - protein, 16 aa, Artificial Sequence
  Synthetic Sequence
AITDQGRTTYADSVKG

SEQ ID NO: 652 - protein, 16 aa, Artificial Sequence
  Synthetic Sequence
GITTQGRITYGNSVRG

SEQ ID NO: 653 - protein, 16 aa, Artificial Sequence
  Synthetic Sequence
AITSGGRTTYVDSVKG

SEQ ID NO: 654 - protein, 18 aa, Artificial Sequence
  Synthetic Sequence
AAINWRGGDTYYADSVKG

SEQ ID NO: 655 - protein, 16 aa, Artificial Sequence
  Synthetic Sequence
AITDGGAKTYADSVKG

SEQ ID NO: 656 - protein, 16 aa, Artificial Sequence
  Synthetic Sequence
AITNQGRLSYVDSVKG

SEQ ID NO: 657 - protein, 16 aa, Artificial Sequence
  Synthetic Sequence
AITNQGRRTYADSVKG

SEQ ID NO: 658 - protein, 16 aa, Artificial Sequence
  Synthetic Sequence
AITNGGRIAYTDSVKG

SEQ ID NO: 659 - protein, 16 aa, Artificial Sequence
  Synthetic Sequence
AITNGGRTTYADSVKG

SEQ ID NO: 660 - protein, 16 aa, Artificial Sequence
  Synthetic Sequence
AITDGGRLTYADSAKG

SEQ ID NO: 661 - protein, 17 aa, Artificial Sequence
  Synthetic Sequence
AISWSGGSTEYHDSVKG

SEQ ID NO: 662 - protein, 16 aa, Artificial Sequence
  Synthetic Sequence
AITNQGRIAYADSVKG

SEQ ID NO: 663 - protein, 17 aa, Artificial Sequence
  Synthetic Sequence
AINWSSGGISYSNSAKG

SEQ ID NO: 664 - protein, 16 aa, Artificial Sequence
  Synthetic Sequence
AITGQGRTTYADSVKG

SEQ ID NO: 665 - protein, 16 aa, Artificial Sequence
  Synthetic Sequence
AITNGGQIVYADSVKG

SEQ ID NO: 666 - protein, 16 aa, Artificial Sequence
  Synthetic Sequence
AITTQGRTTYEDSVKG

SEQ ID NO: 667 - protein, 16 aa, Artificial Sequence
  Synthetic Sequence
AITSGGITNYANSVQG

SEQ ID NO: 668 - protein, 16 aa, Artificial Sequence
  Synthetic Sequence
AITVGGRLAYADSAKG

SEQ ID NO: 669 - protein, 16 aa, Artificial Sequence
  Synthetic Sequence
GITGGGQITYANSVRG

SEQ ID NO: 670 - protein, 16 aa, Artificial Sequence
  Synthetic Sequence
AITSQGRSTYADSAKG

SEQ ID NO: 671 - protein, 16 aa, Artificial Sequence
  Synthetic Sequence
AITNGGATVYADSVKG

SEQ ID NO: 672 - protein, 16 aa, Artificial Sequence
  Synthetic Sequence
AITDGGRLTYADSAKN

SEQ ID NO: 673 - protein, 17 aa, Artificial Sequence
  Synthetic Sequence
AINWSSGGISYSNAAKG

SEQ ID NO: 674 - protein, 16 aa, Artificial Sequence
  Synthetic Sequence
  misc_feature (5)..(5): Xaa can be any naturally occurring amino acid
AITNXGRTTYADSVKG

SEQ ID NO: 675 - protein, 17 aa, Artificial Sequence
  Synthetic Sequence
AIWWASGGISYANSAKG

SEQ ID NO: 676 - protein, 16 aa, Artificial Sequence
  Synthetic Sequence
AITNQGAPTYADSVKG

SEQ ID NO: 677 - protein, 7 aa, Artificial Sequence
  Synthetic Sequence
FTRRDDY

SEQ ID NO: 678 - protein, 7 aa, Artificial Sequence
  Synthetic Sequence
FQSSGID

SEQ ID NO: 679 - protein, 8 aa, Artificial Sequence
  Synthetic Sequence
WAADYQQY

SEQ ID NO: 680 - protein, 8 aa, Artificial Sequence
  Synthetic Sequence
WNRDRQQY

SEQ ID NO: 681 - protein, 13 aa, Artificial Sequence
  Synthetic Sequence
KPTPVYGSTVGDY

SEQ ID NO: 682 - protein, 7 aa, Artificial Sequence
  Synthetic Sequence
FTRDKDY

SEQ ID NO: 683 - protein, 8 aa, Artificial Sequence
  Synthetic Sequence
WDRDRQQY

SEQ ID NO: 684 - protein, 7 aa, Artificial Sequence
  Synthetic Sequence
FTRTDDY

SEQ ID NO: 685 - protein, 8 aa, Artificial Sequence
  Synthetic Sequence
YDRSSTPY

SEQ ID NO: 686 - protein, 7 aa, Artificial Sequence
  Synthetic Sequence
FTRGDDY

SEQ ID NO: 687 - protein, 7 aa, Artificial Sequence
  Synthetic Sequence
LNSATTY

SEQ ID NO: 688 - protein, 7 aa, Artificial Sequence
  Synthetic Sequence
YTRDEDY

SEQ ID NO: 689 - protein, 7 aa, Artificial Sequence
  Synthetic Sequence
FTRDEDY

SEQ ID NO: 690 - protein, 13 aa, Artificial Sequence
  Synthetic Sequence
KWYDPLVIEYYDN

SEQ ID NO: 691 - protein, 7 aa, Artificial Sequence
  Synthetic Sequence
KADHNDY

SEQ ID NO: 692 - protein, 8 aa, Artificial Sequence
  Synthetic Sequence
FRSGADDY

SEQ ID NO: 693 - protein, 15 aa, Artificial Sequence
  Synthetic Sequence
EVPSTYSCSGFREDY

SEQ ID NO: 694 - protein, 8 aa, Artificial Sequence
  Synthetic Sequence
FAASGMEY

SEQ ID NO: 695 - protein, 8 aa, Artificial Sequence
  Synthetic Sequence
WTTDRQQY

SEQ ID NO: 696 - protein, 9 aa, Artificial Sequence
  Synthetic Sequence
FAGWGKEDY

SEQ ID NO: 697 - protein, 7 aa, Artificial Sequence
  Synthetic Sequence
FSPTGDY

SEQ ID NO: 698 - protein, 13 aa, Artificial Sequence
  Synthetic Sequence
KASPVYGSTVEDY

SEQ ID NO: 699 - protein, 8 aa, Artificial Sequence
  Synthetic Sequence
STPRGDSY

SEQ ID NO: 700 - protein, 15 aa, Artificial Sequence
  Synthetic Sequence
EAEGSGREGNFYERS

SEQ ID NO: 701 - protein, 7 aa, Artificial Sequence
  Synthetic Sequence
FTRSDDY

SEQ ID NO: 702 - protein, 7 aa, Artificial Sequence
  Synthetic Sequence
FTRDTDY

SEQ ID NO: 703 - protein, 7 aa, Artificial Sequence
  Synthetic Sequence
WTTLGTF

SEQ ID NO: 704 - protein, 8 aa, Artificial Sequence
  Synthetic Sequence
WVRDGQQY

SEQ ID NO: 705 - protein, 13 aa, Artificial Sequence
  Synthetic Sequence
KAIPVYGSTVEDY

SEQ ID NO: 706 - protein, 13 aa, Artificial Sequence
  Synthetic Sequence
KAAATHLSTVADY

SEQ ID NO: 707 - protein, 7 aa, Artificial Sequence
  Synthetic Sequence
FGRFDDY

SEQ ID NO: 708 - protein, 14 aa, Artificial Sequence
  Synthetic Sequence
WGVKTGPESGSGTL

SEQ ID NO: 709 - protein, 10 aa, Artificial Sequence
  Synthetic Sequence
RLTTEYDYAY

SEQ ID NO: 710 - protein, 7 aa, Artificial Sequence
  Synthetic Sequence
FTRGNDY

SEQ ID NO: 711 - protein, 7 aa, Artificial Sequence
  Synthetic Sequence
FSPTDDF

SEQ ID NO: 712 - protein, 13 aa, Artificial Sequence
  Synthetic Sequence
KAIPIYGSTAEDY

SEQ ID NO: 713 - protein, 7 aa, Artificial Sequence
  Synthetic Sequence
FSLTDDY

SEQ ID NO: 714 - protein, 8 aa, Artificial Sequence
  Synthetic Sequence
WTRDRQQY

SEQ ID NO: 715 - protein, 7 aa, Artificial Sequence
  Synthetic Sequence
FTRDEDF

SEQ ID NO: 716 - protein, 14 aa, Artificial Sequence
  Synthetic Sequence
EVEGSGREGNFYGA

SEQ ID NO: 717 - protein, 5 aa, Artificial Sequence
  Synthetic Sequence
PGWDY

SEQ ID NO: 718 - protein, 8 aa, Artificial Sequence
  Synthetic Sequence
YDRSATAY

SEQ ID NO: 719 - protein, 11 aa, Artificial Sequence
  Synthetic Sequence
ASSVLSGTVDY

SEQ ID NO: 720 - protein, 8 aa, Artificial Sequence
  Synthetic Sequence
FAADGMEY

SEQ ID NO: 721 - protein, 13 aa, Artificial Sequence
  Synthetic Sequence
KAAASYVSTVADY

SEQ ID NO: 722 - protein, 6 aa, Artificial Sequence
  Synthetic Sequence
TAKDDY

SEQ ID NO: 723 - protein, 9 aa, Artificial Sequence
  Synthetic Sequence
FTGWGKEDY

SEQ ID NO: 724 - protein, 8 aa, Artificial Sequence
  Synthetic Sequence
YDRSATPY

SEQ ID NO: 725 - protein, 8 aa, Artificial Sequence
  Synthetic Sequence
WARDRQQY

SEQ ID NO: 726 - protein, 8 aa, Artificial Sequence
  Synthetic Sequence
WTKDRQQY

SEQ ID NO: 727 - protein, 7 aa, Artificial Sequence
  Synthetic Sequence
FTRTYDY

SEQ ID NO: 728 - protein, 11 aa, Artificial Sequence
  Synthetic Sequence
ASSILSGTVDY

SEQ ID NO: 729 - protein, 13 aa, Artificial Sequence
  Synthetic Sequence
KPAPVYGSTVGDY

SEQ ID NO: 730 - protein, 6 aa, Artificial Sequence
  Synthetic Sequence
FGSGGG

SEQ ID NO: 731 - protein, 11 aa, Artificial Sequence
  Synthetic Sequence
ASSVLSGTADY

SEQ ID NO: 732 - protein, 134 aa, Artificial Sequence
  Synthetic Sequence
QVQLQESGGGLVQPGGSLRLSCAASGRISSINSMGWYRQAPGNQRELVAAITNGGAKTYADSVKGRFTISTDNAGNTVYLQMDSLRPEDTAVYYCKAFTRRDDYWGQGTQITVSSAAAYPYDVPDYGSHHHHHH

SEQ ID NO: 733 - protein, 134 aa, Artificial Sequence
  Synthetic Sequence
QVQLQESGGGLVQAGGSLRLSCAASGSITSINAMGWYRQAPGKQRELVAAITSGGRLSYADSVKGRFTISRDNAESTVALQMNSLKPEDTAVYSCAAFQSSGIDWGQGTQVTVSSAAAYPYDVPDYGSHHHHHH

SEQ ID NO: 734 - protein, 135 aa, Artificial Sequence
  Synthetic Sequence
QVQLQESGGGLVQPGGSLRLSCAASGRFFRVNAMGWYRQAPGKQRELVAAITNGGQTAYADSVKGRFTISKESARNTVHLQMSSLKPEDTAVYYCTIWAADYQQYWGQGTQVTVSSAAAYPYDVPDYGSHHHHHH

SEQ ID NO: 735 - protein, 135 aa, Artificial Sequence
  Synthetic Sequence
QVQLQESGGGLVQAGESLRLSCAASGSSDSINAMGWYRQAPGKQRELVAAITSGGRSTYIDSAKGRATISRDNARNTAYLQMSSLKAEDTAVYYCTIWNRDRQQYWGQGTQVTVSSAAAYPYDVPDYGSHHHHHH

SEQ ID NO: 736 - protein, 140 aa, Artificial Sequence
  Synthetic Sequence
QVQLQESGGGLVQSGGSLRLSCAASGSVFSINAWGWYRQAPGKQRELVAAITNQGRIAYAPSVNGRFTISRDSAKNTVYLQMNSLKPEDTAVYYCNAKPTPVYGSTVGDYWGQGTQVTVSSAAAYPYDVPDYGSHHHHHH

SEQ ID NO: 737 - protein, 134 aa, Artificial Sequence
  Synthetic Sequence
QVQLQESGGGLVQAGGSLRLSCAASGSILSINSMGWYRPALGNQRELVAAITNDGRTTYVDSVKGRFTISRDNAKNTVYLQMNSLKPEDTAVYWCKAFTRDKDYWGQGTQVTVSSAAAYPYDVPDYGSHHHHHH

SEQ ID NO: 738 - protein, 135 aa, Artificial Sequence
  Synthetic Sequence
  misc_feature (108)..(108): Xaa can be any naturally occurring amino acid
QVQLQESGGGLVQTGGSLRLSCAASVSISSINSMGWYRQAPGKERELVAAVTVGGRYAYADSAKNRFTISRDDAQNTVHLQMSSLRAEDTAVYYCTIWDRDRQQYWGXGTQVTVSSAAAYPYDVPDYGSHHHHHH

SEQ ID NO: 739 - protein, 134 aa, Artificial Sequence
  Synthetic Sequence
QVQLQESGGGLVQPGGSLRLSCAASGRVFSINAMGWYRQAPGKQRELVAAITNQGATTYADSVKGRFTISRDTAGNTVYLQMNSLRPEDTAVHYCKAFTRTDDYWGQGTQVTVSSAAAYPYDVPDYGSHHHHHH

SEQ ID NO: 740 - protein, 135 aa, Artificial Sequence
  Synthetic Sequence
QVQLQESGGGLVQAGGSLRLSCAASVNIDTLNSMAWYRQAPGKQRELVAGITGSGQITYANSVRGRFTVSRDNAKSTVYLQMNTLQPEDTAVYYCAAYDRSSTPYWGQGTQVTVSSAAAYPYDVPDYGSHHHHHH

SEQ ID NO: 741 - protein, 134 aa, Artificial Sequence
  Synthetic Sequence
QVQLQESGGGLVQPGGSLRLSCAASGGISSINSMGWYRQAPGNQRELVAAITNGGRTVYGDSVKGRFTISRDSAGNTVHLQMDSLRPEDTGVYYCKAFTRGDDYWGQGTQVTVSSAAAYPYDVPDYGSHHHHHH

SEQ ID NO: 742 - protein, 134 aa, Artificial Sequence
  Synthetic Sequence
QVQLQESGGGLVQPGGFLSLSCAASGSMHSVNSMAWYRQVPGKQRELVAAITSGGRLAYAPSVNGRFTISRDYAKNTIHLQMNSLEPEDTAVYYCAALNSATTYWGQGTQVTVSSAAAYPYDVPDYGSHHHHHH

SEQ ID NO: 743 - protein, 134 aa, Artificial Sequence
  Synthetic Sequence
QVQLQESGGGLVQAGGSLRLSCAATGDISSINAMGWHRPARGNERELVAAITNGGRTTYVDSVKGRFTISRDNAKNTVYLQMNSLKPEDTAVYFCKAYTRDEDYWGQGTQVTVSSAAAYPYDVPDYGSHHHHHH

SEQ ID NO: 744 - protein, 134 aa, Artificial Sequence
  Synthetic Sequence
QVQLQESGGGLVRAGGSLRLSCAASGSIFSIDAMGWYRPAHGEQRELVAAITTGGRTTYVDSVKGRFTISRDNAKNTVYLQMNSLKPEDTAVYFCKAFTRDEDYWGQGTQVTVSSAAAYPYDVPDYGSHHHHHH

SEQ ID NO: 745 - protein, 140 aa, Artificial Sequence
  Synthetic Sequence
QVQLQESGGGLVQPGGSLRLSCAASGSIFSINAMGWYRQAPGKQRELVAAITNQGRLTYADSVKGRFTISRDNAKNTVFLQMDSLKPEDTAVYYCNAKWYDPLVIEYYDNWGQGTQVTVSSAAAYPYDVPDYGSHHHHHH

SEQ ID NO: 746 - protein, 134 aa, Artificial Sequence
  Synthetic Sequence
QVQLQESGGGLVQPGGSLRLSCAASGSIFSIAAMGWYRQAPGKQRELVAAITSGGRRAYADSVKGRFTISRDNDENTVALQMNSLKPEDTDVYYCNAKADHNDYWGQGTQITVSSAAAYPYDVPDYGSHHHHHH

SEQ ID NO: 747 - protein, 137 aa, Artificial Sequence
  Synthetic Sequence
QVQLQESGGGLVQPGGSLRLSCAAIGNIASITAMGWYRQAPGKQRELVAAITSASASRTTYADSVKGRFTISRDNAKNTVYLQMNSLQPEDTAVYYCKGFRSGADDYWGQGTQVTVSSAAAYPYDVPDYGSHHHHHH

SEQ ID NO: 748 - protein, 143 aa, Artificial Sequence
  Synthetic Sequence
QVQLQESGGGLVQPGGSLRLSCAASGFTFDDYAIGWFRQAPGKEHEGVSCISRSDGSTYYDDSVKGRFTISSDNAKNTVYLQMNSLKPEDTAVYYCAAEVPSTYSCSGFREDYKGKGTQVTVSSAAAYPYDVPDYGSHHHHHH

SEQ ID NO: 749 - protein, 135 aa, Artificial Sequence
  Synthetic Sequence
QVQLQESGGGLVQPGGSLRLSCAASGSISSINAMGWYRQAPGNQRELVAAITNQGRVTYADSVKGRFTISRDGAKNTVYLQMNSLKPEDTAVYYCKVFAASGMEYWGKGTQVTVSSAAAYPYDVPDYGSHHHHHH

SEQ ID NO: 750 - protein, 135 aa, Artificial Sequence
  Synthetic Sequence
QVQLQESGGGLVQAGESLRLSCAASVSIFRSYFMGWYRQAPGKQRELVAAITDGGRLAYADSAKGRFTISREDTRNTVHLQMSSLKAEDTAVYYCTIWTTDRQQYWGQGTQVTVSSAAAYPYDVPDYGSHHHHHH

SEQ ID NO: 751 - protein, 136 aa, Artificial Sequence
  Synthetic Sequence
QVQLQESGGGWVQPGGSLRLSCAATGSIVSINAIGWYRQAPGKQRELVASITNQGIRNYSTSVMGRFTISRDDVKNTVSLQMNSLKPEDSAVYYCKGFAGWGKEDYWGQGTQVTVSSAAAYPYDVPDYGSHHHHHH

SEQ ID NO: 752 - protein, 134 aa, Artificial Sequence
  Synthetic Sequence
QVQLQESGGGLVQAGASLRLSCAASGSIFSINAMGWYRQAPGKQRELVAAITNQGRTTYADSVKGRFTISRDNAKNTVYLQMDSLEPEDTAIYYCKGFSPTGDYWGQGTQVTVSSAAAYPYDVPDYGSHHHHHH

SEQ ID NO: 753 - protein, 140 aa, Artificial Sequence
  Synthetic Sequence
QVQLQESGGGLVQPGGSLRLSCLASRSFSSFNAMGWYRQAPGKERELVAAITNGGRIAYGIAVNGRFTISRDNAKNTVYLQMNSLKPEDTAVYYCNAKPTPVYGSTVGDYWGQGTQVTVSSAAAYPYDVPDYGSHHHHHH

SEQ ID NO: 754 - protein, 140 aa, Artificial Sequence
  Synthetic Sequence
QVQLQESGGGLVQAGGSLTLSCAASGSFSSINAMGYYRQAPGKQRELVAAITNGGRIAYSDSAKGRFTISRDSAKNTMYLQMNSLKPEDTDVYYCNAKASPVYGSTVEDYWGQGTQVTVSSAAAYPYDVPDYGSHHHHHH

SEQ ID NO: 755 - protein, 135 aa, Artificial Sequence
  Synthetic Sequence
QVQLQESGGGLVQPGGSLRLSCAASGTSFSINGMAWYRQAPGGQRELVGGITSDGSTGYADSVKGRFTVSRDNAKNTVYLQMNRLKPEDTAVYYCGTSTPRGDSYWGQGTQVTVSSAAAYPYDVPDYGSHHHHHH

SEQ ID NO: 756 - protein, 145 aa, Artificial Sequence
  Synthetic Sequence
QVQLQESGGGLVQAGGSLRLSCAASGRTFSTYAMGWFRQAPGKERGLVAAISWSGGSTYYADSVKGRFTIFRDNAENTVYLQMNSLKPEDTAVYYCAAEAEGSGREGNFYERSWYQGQGTQVTVSSAAAYPYDVPDYGSHHHHHH

SEQ ID NO: 757 - protein, 135 aa, Artificial Sequence
  Synthetic Sequence
QVQLQESGGGLVETGGSLRLSCAASGSIFSINAMGWYRQAPGKQRELVAAITDQGRLAYADSAKGRFTISRENARNTLHLQMSSLKAEDTAVYYCTIWDRDRQQYWGQGTQVTVSSAAAYPYDVPDYGSHHHHHH

SEQ ID NO: 758 - protein, 134 aa, Artificial Sequence
  Synthetic Sequence
QVQLQESGGGLVQPGGSLRLSCAASGRIFDINAMGWYRQAPGKQRELVAAITNGGQTTYADSVKGRFTISRDNAGNTVYLQMNSLRPEDTAVYYCKAFTRSDDYWGQGTQVTVSSAAAYPYDVPDYGSHHHHHH

SEQ ID NO: 759 - protein, 135 aa, Artificial Sequence
  Synthetic Sequence
QVQLQESGGGLVQAGGSLRLSCAASGTLFSINGMAWYRQAPGKRRELVGGITSDGSTGYADSVKGRFTISRDNAKNTAYLQMNSLKPEDTAVYYCGTSTPRGDSYWGQGTQVTVSSAAAYPYDVPDYGSHHHHHH

SEQ ID NO: 760 - protein, 134 aa, Artificial Sequence
  Synthetic Sequence
QVQLQESGGGLVQAGGSLRLSCAASGSIDSINAMGWYRPALGEQRELVAAITTGGRTAYVDSVKGRFTISRDAAKNTVYLQMNSLKPEDTAVYSCKAFTRDTDYWGQGTQVTVSSAAAYPYDVPDYGSHHHHHH

SEQ ID NO: 761 - protein, 134 aa, Artificial Sequence
  Synthetic Sequence
QVQLQESGGGLAQPGGSLQLSCAASGRAFSTNSMGWYRQASGKQRELVAAITSQGRITLADSVKGRFTISSDNTKNTVFLQMNSLKPEDTAVYYCNAWTTLGTFGGQGTQVTVSSAAAYPYDVPDYGSHHHHHH

SEQ ID NO: 762 - protein, 136 aa, Artificial Sequence
  Synthetic Sequence
QVQLQESGGGLVQTGESLSLSCAVASGSIISINSMGWYRQAPEKQRELVAAITVDGRLAYADSAKHRFTISKESARNTVHLHMSSLKPEDTAVYYCTIWVRDGQQYWGQGTQVTVSSAAAYPYDVPDYGSHHHHHH

SEQ ID NO: 763 - protein, 140 aa, Artificial Sequence
  Synthetic Sequence
QVQLQESGGGLVQPGGSLRLSCAVSRNFFSINAMGWYRQAPGKQRELVAAITNGGRIAYGTSVMGRFTISRDDAKNTVDLQMNSLRPEDTAVYYCNAKAIPVYGSTVEDYWGQGTQVTVSSAAAYPYDVPDYGSHHHHHH

SEQ ID NO: 764 - protein, 140 aa, Artificial Sequence
  Synthetic Sequence
QVQLQESGGGLVQPGGSLRLSCAASGRFFRVNAMGWYRQVPGKQRELVAAITNGGQIAYADSVKGRFTISRDSAKNTVYLQMNSLKSEDTDVYYCNAKAAATHLSTVADYWGQGTQVTVSSAAAYPYDVPDYGSHHHHHH

SEQ ID NO: 765 - protein, 136 aa, Artificial Sequence
  Synthetic Sequence
QVQLQESGGGLVQPGGSLRLSCAASGSIVSINSMGWYRQAPGKQRELVAAITDQGRTTYADSVKGRFTISRDDAKNKNTVYLQMNSLKAEDTAVYACKAFGRFDDYWGQGTQVTVSSAAAYPYDVPDYGSHHHHHH

SEQ ID NO: 766 - protein, 141 aa, Artificial Sequence
  Synthetic Sequence
QVQLQESGGGLVQPGGSLRLSCAAYGSIFSINAMGWYRQAPGKERELVAGITTQGRITYGNSVRGRFTISGDNAKNTVYLQMKSLKPEDTAVYYCSAWGVKTGPESGSGTLEGQGTQVTVSSAAAYPYDVPDYGSHHHHHH

SEQ ID NO: 767 - protein, 134 aa, Artificial Sequence
  Synthetic Sequence
QVQLQESGGGLVQAGGSLRLSCAASGSIIGINSMGYYRTAPGKQRELVAAITSGGRTTYVDSVKGRFTISRDNAKNTVYLQMNSLKPEDTAVYFCKAFTRDEDYWGQGTQVTVSSAAAYPYDVPDYGSHHHHHH

SEQ ID NO: 768 - protein, 138 aa, Artificial Sequence
  Synthetic Sequence
QVQLQESGGGLVQAGGSLRLSCAASGRTFPGYVMAWFRQSPGQEREFAAAINWRGGDTYYADSVKGRFTISRDNVKNTVFLQMNSLKPEDTAVYFCAARLTTEYDYAYWGQGTQVTVSSAAAYPYDVPDYGSHHHHHH

SEQ ID NO: 769 - protein, 134 aa, Artificial Sequence
  Synthetic Sequence
QVQLQESGGGLVQPGESLRLSCAASGSIFSINAMGWYRQAPGKQRELVAAITDGGAKTYADSVKGRFTISTDNAGNTVYLQMDSLRPEDTAVYYCKAFTRGNDYWGQGTQVTVSSAAAYPYDVPDYGSHHHHHH

SEQ ID NO: 770 - protein, 134 aa, Artificial Sequence
  Synthetic Sequence
QVQLQESGGGLVQAGESLRLSCVVSGRTFSINAMGWYRQAPGKQRELVAAITNQGRLSYVDSVKGRFTISRDNAANTVYLQMNSLKPEDTAVYYCAAFQSSGIDWGQGTQVTVSSAAAYPYDVPDYGSHHHHHH

SEQ ID NO: 771 - protein, 134 aa, Artificial Sequence
  Synthetic Sequence
QVQLQESGGGLVQAGGSLRLSCAASGRTLSSYTIGWYRQAPGKQRELVAAITNQGRRTYADSVKGRFTISRDNAKNTVYLQMDSLKSEDTAVYYCKGFSPTDDFWGQGTQVTVSSAAAYPYDVPDYGSHHHHHH

SEQ ID NO: 772 - protein, 140 aa, Artificial Sequence
  Synthetic Sequence
QVQLQESGGGLVQPGGSLRLSCTASGSFFSINAMGWYRQAPGNQRELVAAITNGGRIAYTDSVKGRFTISNDNAKNTVYLQMNSLKPEDTDVYYCNAKAIPIYGSTAEDYWGQGTQVTVSSAAAYPYDVPDYGSHHHHHH

SEQ ID NO: 773 - protein, 134 aa, Artificial Sequence
  Synthetic Sequence
QVQLQESGGGLVQAGGSLRLSCAASGSIFSINSMGWYRQAPGKQRELVAAITNGGRTTYADSVKGRFTISRDNAKNTVYLQMDSLKPEDTAVYYCKGFSLTDDYWGQGTQVTVSSAAAYPYDVPDYGSHHHHHH

SEQ ID NO: 774 - protein, 135 aa, Artificial Sequence
  Synthetic Sequence
QVQLQESGGGLVQTGGSLRLSCAASGSIFSFNAMGWYRQAPGKQRELVAAITDGGRLTYADSAKGRFTISRENTRNTVHLQMSSLKAEDTADYYCTIWTRDRQQYWGQGTQVTVSSAAAYPYDVPDYGSHHHHHH

SEQ ID NO: 775 - protein, 134 aa, Artificial Sequence
  Synthetic Sequence
QVQLQESGGGLVQAGGSLRLSCAASGSIFSINAMGWYRPALGEQRELVAAITTGGRTTYVDSVKGRFSISRDNAKNTVYLQMNSLKPEDTAVYFCKAFTRDEDFWGQGTQVTVSSAAAYPYDVPDYGSHHHHHH

SEQ ID NO: 776 - protein, 145 aa, Artificial Sequence
  Synthetic Sequence
QVQLQESGGGLVQAGGSLRLSCEASGRTFSTYAMAWFRQAPGKERDLVAAISWSGGSTEYHDSVKGRFTISRDNTKNTVYLQMNSLKAEDTAVYYCAAEVEGSGREGNFYGASWYPGQGTQVTVSSAAAYPYDVPDYGSHHHHHH

SEQ ID NO: 777 - protein, 132 aa, Artificial Sequence
  Synthetic Sequence
QVQLQESGGGLVQPGGSLRLSCAASGSFFSINAMGWYRQAPGKQRELVAAITNQGRIAYADSVKGRFTISRDNAKNTVYLQMNSLKPEDTAVYYCGRPGWDYWGQGTQVTVSSAAAYPYDVPDYGSHHHHHH

SEQ ID NO: 778 - protein, 135 aa, Artificial Sequence
  Synthetic Sequence
QVQLQESGGGLVQAGGSLRLSCVASVNIGSLNSMVWYRQSPGKQRELVAGITGSGQITYANSVRGRFTVSRDIAKSTAYLQMNTLKPEDTAVYYCAAYDRSATAYWGQGTQVTVSSAAAYPYDVPDYGSHHHHHH

SEQ ID NO: 779 - protein, 139 aa, Artificial Sequence
  Synthetic Sequence
QVQLQESGGGLVQAGGSLRVSCAASGRTLSNYAVGWWRQAPGKQREFVAAINWSSGGISYSNSAKGRFALSRDNAKNTVYLQMDSLKPEDTAVYYCAAASSVLSGTVDYWGQGTQVTVSSAAAYPYDVPDYGSHHHHHH

SEQ ID NO: 780 - protein, 135 aa, Artificial Sequence
  Synthetic Sequence
QVQLQESGGGLVQPGGSLRLSCAASGSISSINAMGWYRQAPGKQRELVAAITGQGRTTYADSVKGRFTISRDGAKNTVYLQMNSLKPEDTAVYYCKVFAADGMEYWGKGTQVTVSSAAAYPYDVPDYGSHHHHHH

SEQ ID NO: 781 - protein, 140 aa, Artificial Sequence
  Synthetic Sequence
QVQLQESGGGLVQPGGSLRLSCAASGRFFRVNAMGWYRQAPGKQRELVAAITNGGQIVYADSVKGRFTISRDSAKNTVYLQMNSLKSEDTAVYYCNAKAAASYVSTVADYWGQGTQVTVSSAAAYPYDVPDYGSHHHHHH

SEQ ID NO: 782 - protein, 134 aa, Artificial Sequence
  Synthetic Sequence
QVQLQESGGGLVQAGGSLRLSCAASGSVFSINAMGWYRQAPEKQRELVAAITTQGRTTYEDSVKGRFTISRDGAQNTVYLQMDSLKPEDTAVYYCKAWTAKDDYWGKGTQVTVSSAAAYPYDVPDYGSHHHHHH

SEQ ID NO: 783 - protein, 136 aa, Artificial Sequence
  Synthetic Sequence
QVQLQESGGGRVQPGGSLRLSCAAIGSIFEINSIGWYRQAPGKQRELVAAITSGGITNYANSVQGRSTISRDNVNNTVYLQMNSLKPEDSAVYYCKGFTGWGKEDYWGQGTQVTVSSAAAYPYDVPDYGSHHHHHH

SEQ ID NO: 784 - protein, 135 aa, Artificial Sequence
  Synthetic Sequence
QVQLQESGGGLVQTGGSLRLSCAASGSIFNINSMGWYRQAPGKQRELVAAITVGGRLAYADSAKGRFTISKESARNTVHLQMSSLKPEDTAVYYCTIWAADYQQYWGQGTQVTVSSAAAYPYDVPDYGSHHHHHH

SEQ ID NO: 785 - protein, 135 aa, Artificial Sequence
  Synthetic Sequence
QVQLQESGGGLVQAGGSLRLSCAASVNIGTLNSMAWYREAPGKQRELVAGITGGGQITYANSVRGRFTVSRDIAKSTAYLQMNTLKPEDTAVYYCAAYDRSATPYWGQGTQVTVSSAAAYPYDVPDYGSHHHHHH

SEQ ID NO: 786 - protein, 135 aa, Artificial Sequence
  Synthetic Sequence
QVQLQESGGGLVQTGGSLRLSCAASGSIFSINSMGWYRQAPGKQRELVAAITSQGRSTYADSAKGRFTISLGNARNTVNLQMSSLKTEDTAVYYCTIWARDRQQYWGQGTQVTVSSAAAYPYDVPDYGSHHHHHH

SEQ ID NO: 787 - protein, 134 aa, Artificial Sequence
  Synthetic Sequence
QVQLQESGGGLVQPGGSLRLSCAASGRIGSINSMGWYRQAPGKQREMVAAITNGGATVYADSVKGRFTISRDNAGNTVDLHMNSLRPEDSAVYYCKAFTRGDDYWGQGTQVTVSSAAAYPYDVPDYGSHHHHHH

SEQ ID NO: 788 - protein, 135 aa, Artificial Sequence
  Synthetic Sequence
QVQLQESGGGLVQPGGSLKLSCAASGSIFSFNAMGWYRQAPGKQRELVAAITDGGRLTYADSAKNRFTISRENTRNTVHLQMSSLKAEDTAVYYCTIWTKDRQQYWGQGTQVTVSSAAAYPYDVPDYGSHHHHHH

SEQ ID NO: 789 - protein, 134 aa, Artificial Sequence
  Synthetic Sequence
QVQLQESGGGLVQPGGSLRLSCAASGRISSINSMGWYRQAPGKQRELVAAITNGGAKTYADSVKGRFTISRDGAGNTVYLQMDNLRPEDTAVYYCKAFTRTYDYWGQGTQVTVSSAAAYPYDVPDYGSHHHHHH

SEQ ID NO: 790 - protein, 139 aa, Artificial Sequence
  Synthetic Sequence
QVQLQESGGGLVQAGGSLRVSCAASGRTLSNYAVAWFRQAPGKQREFVAAINWSSGGISYSNAAKGRFALSRDNAKNTVYLQMDSLKPEDTAVYYCAAASSILSGTVDYWGQGTQVTVSSAAAYPYDVPDYGSHHHHHH

SEQ ID NO: 791 - protein, 135 aa, Artificial Sequence
  Synthetic Sequence
QVQLQESGGGLVQPGGSLRLSCAASGRIGSINSMGWYRQAPGKQREMVAAITNGGATVYADSVKGRFTISRDNAGNTVDLHMNSLRPEDSAVYYCTIWAADYQQYWGQGTQVTVSSAAAYPYDVPDYGSHHHHHH

SEQ ID NO: 792 - protein, 140 aa, Artificial Sequence
  Synthetic Sequence
QVQLQESGGGLVQPGGSLRLSCAASRSFFSFNAMGWYRQAPGKQRELVAAITNGGRIAYGTSVMGRFTISRDNAKNTVYLQMDSLKPEDTAVYYCNAKPAPVYGSTVGDYWGQGTQVTVSSAAAYPYDVPDYGSHHHHHH

SEQ ID NO: 793 - protein, 135 aa, Artificial Sequence
  Synthetic Sequence
QVQLQESGGGLVQPGGSPRLSCAASGRFFRVNAMGWYRQAPGKQRELVAAITNGGQTAYADSVKGRFTISRDSAKNTVYLQMNSLKSEDTAVYYCKVFAADGMEYWGKGTQVTVSSAAAYPYDVPDYGSHHHHHH

SEQ ID NO: 794 - protein, 133 aa, Artificial Sequence
  Synthetic Sequence
  misc_feature (54)..(54): Xaa can be any naturally occurring amino acid
QVQLQESGGGLVQPGESLRLSCAASGIIFSINAMGWYRQAPGKQRELVAAITNXGRTTYADSVKGRFTISRDNAKNTVTLQMNSLKPEDTAVYYCNAFGSGGGVGQGTQVTVSSAAAYPYDVPDYGSHHHHHH

SEQ ID NO: 795 - protein, 139 aa, Artificial Sequence
  Synthetic Sequence
QVQLQESGGGLVQAGGSLRLSCAASGRTLSNYAVAWFRQAPGKQRELVAAIWWASGGISYANSAKGRFVLSRDNAKNTVYLQMDSLKPEDTAVYYCAAASSVLSGTADYWGQGTQVTVSSAAAYPYDVPDYGSHHHHHH

SEQ ID NO: 796 - protein, 134 aa, Artificial Sequence
  Synthetic Sequence
QVQLQESGGGLVQPGGSLRLSCAASGRIFSVNAMGWYRQAPGKQRELVAAITNQGAPTYADSVKGRFTISRDNAGNTVYLQMNSLRPEDTAVYYCKAFTRGDDYWGQGTQVTVSSAAAYPYDVPDYGSHHHHHH

SEQ ID NO: 797 - protein, 144 aa, Artificial Sequence
  Synthetic Sequence
QVQLQESGGGSVQAGGSLRLSCAASGRTFSSYAMAWFRQAPGMERELVAAISWSGGSTYYADSVKGRFTISRDNAENTVYLQMNSLKPEDTAVYYCAAEAEGSGREGNFYERSWYQGQGTQVTVSSAAAYPYDVPDYGSHHHHH

SEQ ID NO: 798 - protein, 10 aa, Artificial Sequence
  Synthetic Sequence
GFSMDYYAIA

SEQ ID NO: 799 - protein, 10 aa, Artificial Sequence
  Synthetic Sequence
GFSVDYYAIA

SEQ ID NO: 800 - protein, 10 aa, Artificial Sequence
  Synthetic Sequence
GGFNRVSYMG

SEQ ID NO: 801 - protein, 10 aa, Artificial Sequence
  Synthetic Sequence
GIIKSINFMG

SEQ ID NO: 802 - protein, 10 aa, Artificial Sequence
  Synthetic Sequence
GFILDYYGIG

SEQ ID NO: 803 - protein, 10 aa, Artificial Sequence
  Synthetic Sequence
GLSLDYDGVG

SEQ ID NO: 804 - protein, 10 aa, Artificial Sequence
  Synthetic Sequence
GRTFSSLGMG

SEQ ID NO: 805 - protein, 10 aa, Artificial Sequence
  Synthetic Sequence
GFAFGSYDMG

SEQ ID NO: 806 - protein, 10 aa, Artificial Sequence
  Synthetic Sequence
GFSFGNNDMS

SEQ ID NO: 807 - protein, 11 aa, Artificial Sequence
  Synthetic Sequence
CITGSDFMVDT

SEQ ID NO: 808 - protein, 8 aa, Artificial Sequence
  Synthetic Sequence
SVTSGGEI

SEQ ID NO: 809 - protein, 8 aa, Artificial Sequence
  Synthetic Sequence
STTSDGRT

SEQ ID NO: 810 - protein, 9 aa, Artificial Sequence
  Synthetic Sequence
CISSSDGST

SEQ ID NO: 811 - protein, 9 aa, Artificial Sequence
  Synthetic Sequence
AIAWNGAST

SEQ ID NO: 812 - protein, 9 aa, Artificial Sequence
  Synthetic Sequence
GINSGGRIT

SEQ ID NO: 813 - protein, 9 aa, Artificial Sequence
  Synthetic Sequence
AINSGGGST

SEQ ID NO: 814 - protein, 19 aa, Artificial Sequence
  Synthetic Sequence
AVRSTANTLCPSHYSVMDY

SEQ ID NO: 815 - protein, 19 aa, Artificial Sequence
  Synthetic Sequence
AVRSTANTLCPSHYSIMDY

SEQ ID NO: 816 - protein, 14 aa, Artificial Sequence
  Synthetic Sequence
NADIWVSDARMYNY

SEQ ID NO: 817 - protein, 14 aa, Artificial Sequence
  Synthetic Sequence
NADIWLPSDRMYNY

SEQ ID NO: 818 - protein, 13 aa, Artificial Sequence
  Synthetic Sequence
ATATLCDGGIWGY

SEQ ID NO: 819 - protein, 17 aa, Artificial Sequence
  Synthetic Sequence
AASGLGSVVVTANEYDY

SEQ ID NO: 820 - protein, 15 aa, Artificial Sequence
  Synthetic Sequence
AQGDRSSWHYYGMDY

SEQ ID NO: 821 - protein, 13 aa, Artificial Sequence
  Synthetic Sequence
ATKSDPMTNEYDL

SEQ ID NO: 822 - protein, 147 aa, Artificial Sequence
  Synthetic Sequence
QVQLQESGGGLVQPGGSLRLSCAASGFSMDYYAIAWFRQAPGKEREEISCITGSDFMVDTYYVASVKGRFTISRDNAENTAYLQMNNLKPEDTGVYFCAVRSTANTLCPSHYSVMDYWGKGTQVTVSSAAAYPYDVPDYGSHHHHHH

SEQ ID NO: 823 - protein, 147 aa, Artificial Sequence
  Synthetic Sequence
QVQLQESGGGLVQAGGSLRLSCAASGFSMDYYAIAWFRQAPGKEREEISCITGSDFMVDTYYVASVKGRFTISRDNAENTAYLQMNNLKPEDTGVYFCAVRSTANTLCPSHYSVMDYWGKGTQVTVSSAAAYPYDVPDYGSHHHHHH

SEQ ID NO: 824 - protein, 146 aa, Artificial Sequence
  Synthetic Sequence
QVQLQESGGGLVQPGGSLRLSCSASGFSVDYYAIAWFRQAPGKEREEISCITGSDFMVDTYYVASVKGRFTISRDNAKNTAYLQMNSLKPEDTGVYFCAVRSTANTLCPSHYSIMDYWGKGTQVTVSSAAAYPYDVPDYGSHHHHH

SEQ ID NO: 825 - protein, 147 aa, Artificial Sequence
  Synthetic Sequence
QVQLQESGGGLVQPGGSLRLSCSASGFSMDYYAIAWFRQAPGKEREEISCITGSDFMVDTYYVASVKGRFTISRDNAKNTAHLQMNSLKPEDTGVYFCAVRSTANTLCPSHYSVMDYWGKGTQVTVSSAAAYPYDVPDYGSHHHHHH

SEQ ID NO: 826 - protein, 139 aa, Artificial Sequence
  Synthetic Sequence
QVQLQESGGGLVQAGGSLRLSCAASGGFNRVSYMGWYRQAPGTKRELVASVTSGGEITIADSVKGRFTVSRDNSKNTLYLQMNGLKPEDGATYWCNADIWVSDARMYNYWGQGTQVTVSSAAAYPYDVPDYGSHHHHHH

SEQ ID NO: 827 - protein, 139 aa, Artificial Sequence
  Synthetic Sequence
QVQLQESGGGLVQTGESLRLSCAASGGFNRVSYMGWYRQAPGSKRELVASVTSGGEITVADSVKGRFTVSRDNNKNTLYLQMNGLKPEDGATYWCNADIWVSDARMYNYWGQGTQVTVSSAAAYPYDVPDYGSHHHHHH

SEQ ID NO: 828 - protein, 139 aa, Artificial Sequence
  Synthetic Sequence
QVQLQESGGGLVQTGESLRLSCAASGIIKSINFMGWYRQPPGTKRELVASTTSDGRTTVADSVKGRFTISRDNAKNTIYLEMSSLKPEDTATYWCNADIWLPSDRMYNYWGQGTQVTVSSAAAYPYDVPDYGSHHHHHH

SEQ ID NO: 829 - protein, 139 aa, Artificial Sequence
  Synthetic Sequence
QVQLQESGGGLVQAGGSLRLSCAVSGFILDYYGIGWFRQAPGKEREAVSCISSSDGSTYYADSVKGRFTISRDNALNTLYLQMNSLKPEDTAVYHCATATLCDGGIWGYWGQGTQVTVSSAAAYPYDVPDYGSHHHHHH

SEQ ID NO: 830 - protein, 139 aa, Artificial Sequence
  Synthetic Sequence
QVQLQESGGGLAQAGGSLRLSCEGSGLSLDYDGVGWFRQAPGKEREAVSCISSSDGSTYYADSVKGRFTISRGNALNTLYLQMNSLKPEDTAVYYCATATLCDGGIWGYWGQGTQVTVSSAAAYPYDVPDYGSHHHHHH

SEQ ID NO: 831 - protein, 139 aa, Artificial Sequence
  Synthetic Sequence
QVQLQESGGGSVQPGGSLRLSCAVSGFILDYYGIGWFRQAPGKEREAVSCISSSDGSTYYADSVKGRFTISRDNALNTLYLQMNSLKPEDTAVYYCATATLCDGGIWGYWGQGTQVTVSSAAAYPYDVPDYGSHHHHHH

SEQ ID NO: 832 - protein, 143 aa, Artificial Sequence
  Synthetic Sequence
QVQLQESGGGSVQAGDSLRLSCTASGRTFSSLGMGWFRQAPGKEREFVSAIAWNGASTYYTESVKGRFTISRDDAKNTVYLQMNSLKPTDTAVYFCAASGLGSVVVTANEYDYWGQGTQVTVSSAAAYPYDVPDYGSHHHHHH

SEQ ID NO: 833 - protein, 143 aa, Artificial Sequence
  Synthetic Sequence
QVQLQESGGGSVQPGKSLRLSCAASGRTFSSLGMGWFRQAPGKEREFVSAIAWNGASTYYTESVKGRFTISRDDAKNTVYLQMNSLKPTDTAVYFCAASGLGSVVVTANEYDYWGQGTQVTVSSAAAYPYDVPDYGSHHHHHH

SEQ ID NO: 834 - protein, 141 aa, Artificial Sequence
  Synthetic Sequence
QVQLQESGGGLVQPGGSLRLSCTTSGFAFGSYDMGWVRQAPGKGPEWVSGINSGGRITDYADSVTGRFTISRDNAKNTLYLQMNSLKPEDTAVYYCAQGDRSSWHYYGMDYWGKGTQVTVSSAAAYPYDVPDYGSHHHHHH

SEQ ID NO: 835 - protein, 139 aa, Artificial Sequence
  Synthetic Sequence
  misc_feature (112)..(112): Xaa can be any naturally occurring amino acid
QVQLQESGGGLVQPGGSLRLSCAASGFSFGNNDMSWVRQAPGKGPEWVSAINSGGGSTYYADSVKGRFTISRDNAKNTLYLQMNSLKPEDTAVYYCATKSDPMTNEYDLWGXGTQVTVSSAAAYPYDVPDYGSHHHHHH

SEQ ID NO: 836 - protein, 10 aa, Artificial Sequence
  Synthetic Sequence
GFTLDYYAIG

SEQ ID NO: 837 - protein, 10 aa, Artificial Sequence
  Synthetic Sequence
GTIFSINHMD

SEQ ID NO: 838 - protein, 10 aa, Artificial Sequence
  Synthetic Sequence
GFTFDDYGMS

SEQ ID NO: 839 - protein, 10 aa, Artificial Sequence
  Synthetic Sequence
GFTLDYYAIN

SEQ ID NO: 840 - protein, 10 aa, Artificial Sequence
  Synthetic Sequence
GTIFSINRMD

SEQ ID NO: 841 - protein, 10 aa, Artificial Sequence
  Synthetic Sequence
GFTFSSYGMS

SEQ ID NO: 842 - protein, 10 aa, Artificial Sequence
  Synthetic Sequence
GKIFSGNDMG

SEQ ID NO: 843 - protein, 10 aa, Artificial Sequence
  Synthetic Sequence
GFTFNDYAMS

SEQ ID NO: 844 - protein, 10 aa, Artificial Sequence
  Synthetic Sequence
GFNLDPYAIA

SEQ ID NO: 845 - protein, 10 aa, Artificial Sequence
  Synthetic Sequence
GFTFTAYAMS

SEQ ID NO: 846 - protein, 10 aa, Artificial Sequence
  Synthetic Sequence
GFTFDYYAIG

SEQ ID NO: 847 - protein, 10 aa, Artificial Sequence
  Synthetic Sequence
GFNLDPYAIG

SEQ ID NO: 848 - protein, 10 aa, Artificial Sequence
  Synthetic Sequence
ESIFSIEAMG

SEQ ID NO: 849 - protein, 10 aa, Artificial Sequence
  Synthetic Sequence
GRTFSISAMG

SEQ ID NO: 850 - protein, 9 aa, Artificial Sequence
  Synthetic Sequence
ISSSDGSTY

SEQ ID NO: 851 - protein, 8 aa, Artificial Sequence
  Synthetic Sequence
ITSDGFPT

SEQ ID NO: 852 - protein, 9 aa, Artificial Sequence
  Synthetic Sequence
IRWNGGSTN

SEQ ID NO: 853 - protein, 8 aa, Artificial Sequence
  Synthetic Sequence
ITSDGTPT

SEQ ID NO: 854 - protein, 9 aa, Artificial Sequence
  Synthetic Sequence
IDSGGGSTS

SEQ ID NO: 855 - protein, 8 aa, Artificial Sequence
  Synthetic Sequence
ITSGGITD

SEQ ID NO: 856 - protein, 9 aa, Artificial Sequence
  Synthetic Sequence
IRSNGGYTN

SEQ ID NO: 857 - protein, 9 aa, Artificial Sequence
  Synthetic Sequence
ISSSDVGTY

SEQ ID NO: 858 - protein, 9 aa, Artificial Sequence
  Synthetic Sequence
INSSDGSTY

SEQ ID NO: 859 - protein, 9 aa, Artificial Sequence
  Synthetic Sequence
ISGSDSSTY

SEQ ID NO: 860 - protein, 8 aa, Artificial Sequence
  Synthetic Sequence
ITSDGTPA

SEQ ID NO: 861 - protein, 9 aa, Artificial Sequence
  Synthetic Sequence
ISSGDGSKY

SEQ ID NO: 862 - protein, 8 aa, Artificial Sequence
  Synthetic Sequence
IFGGGFTN

SEQ ID NO: 863 - protein, 9 aa, Artificial Sequence
  Synthetic Sequence
ITWSGGSTS

SEQ ID NO: 864 - protein, 16 aa, Artificial Sequence
  Synthetic Sequence
DGWSSCRHGINEYLYW

SEQ ID NO: 865 - protein, 8 aa, Artificial Sequence
  Synthetic Sequence
SSGVYNYW

SEQ ID NO: 866 - protein, 12 aa, Artificial Sequence
  Synthetic Sequence
QGYYCSGYGCPR

SEQ ID NO: 867 - protein, 17 aa, Artificial Sequence
  Synthetic Sequence
SGWRLCRPTDEYDYSYW

SEQ ID NO: 868 - protein, 14 aa, Artificial Sequence
  Synthetic Sequence
QGYYCSGYGCSDYW

SEQ ID NO: 869 - protein, 7 aa, Artificial Sequence
  Synthetic Sequence
RDRTIWW

SEQ ID NO: 870 - protein, 12 aa, Artificial Sequence
  Synthetic Sequence
QGYYCSGYGCYP

SEQ ID NO: 871 - protein, 15 aa, Artificial Sequence
  Synthetic Sequence
DGYYYCSDYPHPLYW

SEQ ID NO: 872 - protein, 15 aa, Artificial Sequence
  Synthetic Sequence
DGWRDCTWSNEYAYW

SEQ ID NO: 873 - protein, 15 aa, Artificial Sequence
  Synthetic Sequence
TGWRTCRGLNEYDYW

SEQ ID NO: 874 - protein, 13 aa, Artificial Sequence
  Synthetic Sequence
DLVSGSSRLYDYW

SEQ ID NO: 875 - protein, 18 aa, Artificial Sequence
  Synthetic Sequence
MGRTNYGVIYDPNMYNYW

SEQ ID NO: 876 - protein, 17 aa, Artificial Sequence
  Synthetic Sequence
SGWRLCRPTDEYDYLYW

SEQ ID NO: 877 - protein, 143 aa, Artificial Sequence
  Synthetic Sequence
QVQLQESGGGLVQAGGSLRLSCAASGFTLDYYAIGWFRQAPGKEREEVSCISSSDGSTYYADSVKGRFTISRDNAKNTVNLQMNSLKPEDTAVYYCATDGWSSCRHGINEYLYWGQGTQVTVSSAAAYPYDVPDYGSHHHHHH

SEQ ID NO: 878 - protein, 134 aa, Artificial Sequence
  Synthetic Sequence
QVQLQESGGGLVQAGGSLRLSCTASGTIFSINHMDWFRQAPGKQRELVALITSDGFPTYADSAKGRFTISRDNTKKTVSLQMNSLKPEDTAVYYCHVSSGVYNYWGQGTQVTVSSAAAYPYDVPDYGSHHHHHH

SEQ ID NO: 879 - protein, 138 aa, Artificial Sequence
  Synthetic Sequence
QVQLQESGGGLVQPGGSLRLSCAASGFTFDDYGMSWVRQAPGKGLEWVSAIRWNGGSTNYADSVKGRFTISRDNAKNTLYLQMNSLKSEDTAVYYCAQGYYCSGYGCPRGQGTQVTVSSAAAYPYDVPDYGSHHHHHH

SEQ ID NO: 880 - protein, 144 aa, Artificial Sequence
  Synthetic Sequence
QVQLQESGGGLVQPGGSLRLSCAASGFTLDYYAINWFRQAPGKEREEVSCISSSDGSTYYADSVKGRFTISRDNAKNTVYLQMNSLKPEDTAVYYCATSGWRLCRPTDEYDYSYWGQGTQVTVSSAAAYPYDVPDYGSHHHHHH

SEQ ID NO: 881 - protein, 134 aa, Artificial Sequence
  Synthetic Sequence
QVQLQESGGGVVQAGGSLRLSCTASGTIFSINRMDWFRQAPGKQRELVALITSDGTPTYADSAKGRFTISRDNTKKTVSLQMNSLKPEDTAVYYCHVSSGVYNYWGQGTQVTVSSAAAYPYDVPDYGSHHHHHH

SEQ ID NO: 882 - protein, 140 aa, Artificial Sequence
  Synthetic Sequence
QVQLQESGGGLVQTGGSLRLSCAASGFTFSSYGMSWVRQTPGKGPEWVSAIDSGGGSTSYADSVKGRFTISRDNAKNTLYLQMNSLKPEDTAVYYCAQGYYCSGYGCSDYWGQGTQVTVSSAAAYPYDVPDYGSHHHHHH

SEQ ID NO: 883 - protein, 133 aa, Artificial Sequence
  Synthetic Sequence
QVQLQESGGGLVQPGGSLRLSCAASGKIFSGNDMGWYRQAPGKQRELVGIITSGGITDYADAVKGRFTISRDNAKNMMYLQMNSLKPEDTAVYYCNMRDRTIWWGQGTQVTVSSAAAYPYDVPDYGSHHHHHH

SEQ ID NO: 884 - protein, 134 aa, Artificial Sequence
  Synthetic Sequence
QVQLQESGGGSVQAGGSLRLSCTASGTIFSINRMDWFRQAPGKQRELVALITSDGTPTYADSAKGRFTISRDNTKKTVSLQMNSLKPEDTAVYYCHVSSGVYNYWGQGTQVTVSSAAAYPYDVPDYGSHHHHHH

SEQ ID NO: 885 - protein, 140 aa, Artificial Sequence
  Synthetic Sequence
QVQLQESGGGLVQPGGSLRLSCAASGFTFSSYGMSWVRQTPGKGPEWVSAIDSGGGSTSYADSVKGRFTTSRDNAKNTLYLQMNSLKPEDTAVYYCAQGYYCSGYGCSDYWGQGTQVTVSSAAAYPYDVPDYGSHHHHHH

SEQ ID NO: 886 - protein, 138 aa, Artificial Sequence
  Synthetic Sequence
QVQLQESGGGLVQPGGSLRLSCAASGFTFNDYAMSWVRQAPGKGLEWVSGIRSNGGYTNYADSVKGRFTISRDNAKNTLYLQMNSLKSEDTAVYYCAQGYYCSGYGCYPGQGTQVTVSSAAAYPYDVPDYGSHHHHHH

SEQ ID NO: 887 - protein, 142 aa, Artificial Sequence
  Synthetic Sequence
QVQLQESGGGLVQAGGSLRLSCAASGFNLDPYAIAWFRQAPGKEREEVSCISSSDVGTYYADSVKGRFTISRDNAKKTVYLQMNSLKPEDTAVYYCATDGYYYCSDYPHPLYWGQGTQVTVSSAAAYPYDVPDYGSHHHHHH

SEQ ID NO: 888 - protein, 142 aa, Artificial Sequence
  Synthetic Sequence
QVQLQESGGGLVQPGGSLRLSCAASGFTFTAYAMSWFRQAPGKEREEVSCINSSDGSTYYADSVKGRFTISRDNAKNTVYLQMNSLKPEDTAVYHCATDGWRDCTWSNEYAYWGQGTQVTVSSAAAYPYDVPDYGSHHHHHH

SEQ ID NO: 889 - protein, 142 aa, Artificial Sequence
  Synthetic Sequence
QVQLQESGGGLVQPGGSLRLSCAASGFTFDYYAIGWFRQAPGKEREEVSCISGSDSSTYYADSVKGRFTIVRDNAQNTVYLQMNSLKPEDTAIYYCAVTGWRTCRGLNEYDYWGQGTQVTVSSAAAYPYDVPDYGSHHHHHH

SEQ ID NO: 890 - protein, 142 aa, Artificial Sequence
  Synthetic Sequence
QVQLQESGGGLVQPGGSLRLSCAASGFNLDPYAIAWFRQAPGKEREEVSCISSSDVGTYYADSVKGRFTISRDNTKKTVYLQMNSLKPEDTAVYYCATDGYYYCSDYPHPLYWGQGTQVTVSSAAAYPYDVPDYGSHHHHHH

SEQ ID NO: 891 - protein, 134 aa, Artificial Sequence
  Synthetic Sequence
QVQLQESGGGLVQAGESLRLSCTASGTIFSINRMDWFRQAPGKQRELVALITSDGTPTYADSAKGRFTISRDNTKKTVSLQMNSLKPEDTAVYYCHVSSGVYNYWGQGTQVTVSSAAAYPYDVPDYGSHHHHHH

SEQ ID NO: 892 - protein, 134 aa, Artificial Sequence
  Synthetic Sequence
QVQLQESGGGLVQAGGSLRLSCTASGTIFSINRMDWFRQAPGKQRELVALITSDGTPAYADSAKGRFTISRDNTKKTVSLQMNSLKPEDTAVYYCHVSSGVYNYWGQGTQVTVSSAAAYPYDVPDYGSHHHHHH

SEQ ID NO: 893 - protein, 140 aa, Artificial Sequence
  Synthetic Sequence
QVQLQESGGGLVQSGGSLRLSCKTSGFTFSSYGMSWVRQTPGKGPEWVSAIDSGGGSTSYADSVKGRFTISRDNAKNTLYLQMNSLKPEDTAVYYCAQGYYCSGYGCSDYWGQGTQVTVSSAAAYPYDVPDYGSHHHHHH

SEQ ID NO: 894 - protein, 142 aa, Artificial Sequence
  Synthetic Sequence
QVQLQESGGGLVQPGGSLRLSCAASGFNLDPYAIGWFRQAPGKEREEVSCISSGDGSKYYADSVKGRFTMSRDNAKKTVYLQMNSLKPEDTAVYYCATDGYYYCSDYPHPLYWGQGTQVTVSSAAAYPYDVPDYGSHHHHHH

SEQ ID NO: 895 - protein, 142 aa, Artificial Sequence
  Synthetic Sequence
QVQLQESGGGLVQPGGSLRLSCAVSGFNLDPYAIAWFRQAPGKEREEVSCISSSDVGTYYADSVKGRFTISRDNAKKTVYLQMNSLKPEDTAVYYCATDGYYYCSDYPHPLYWGQGTQVTVSSAAAYPYDVPDYGSHHHHHH

SEQ ID NO: 896 - protein, 139 aa, Artificial Sequence
  Synthetic Sequence
QVQLQESGGGLVQAGGSLRLSCAASESIFSIEAMGWYRQAPGKQRELVAAIFGGGFTNYADSVKGRFTISRDNANRTVYLQMNSLKPEDTAVYYCNADLVSGSSRLYDYWGQGTQVTVSSAAAYPYDVPDYGSHHHHHH

SEQ ID NO: 897 - protein, 133 aa, Artificial Sequence
  Synthetic Sequence
QVQLQESGGGLVQAGGSLRLSCAASGKIFSGNDMGWYRQAPGKQRELVGIITSGGITDYADAVKGRFTISRDNAKNMMYLQMNSLKPEDTAVYYCNMRDRTIWWGQGTQVTVSSAAAYPYDVPDYGSHHHHHH

SEQ ID NO: 898 - protein, 143 aa, Artificial Sequence
  Synthetic Sequence
QVQLQESGGGLVQPGGSLRLSCAASGFTLDYYAIGWFRQAPGKEREEVSCISSSDGSTYYADSVKGRFTISRDNAKNTVNLQMNSLKPEDTAVYYCATDGWSSCRHGINEYLYWGQGTQVTVSSAAAYPYDVPDYGSHHHHHH

SEQ ID NO: 899 - protein, 140 aa, Artificial Sequence
  Synthetic Sequence
QVQLQESGGGLVQAGGSLRLSCAASGFTFSSYGMSWVRQTPGKGPEWVSAIDSGGGSTSYADSVKGRFTISRDNAKNTLYLQMNSLKPEDTAVYYCAQGYYCSGYGCSDYWGQGTQVTVSSAAAYPYDVPDYGSHHHHHH

SEQ ID NO: 900 - protein, 134 aa, Artificial Sequence
  Synthetic Sequence
QVQLQESGGGLVQPGGSLRLSCTASGTIFSINRMDWFRQAPGKQRELVALITSDGTPTYADSAKGRFTISRDNTKKTVSLQMNSLKPEDTAVYYCHVSSGVYNYWGQGTQVTVSSAAAYPYDVPDYGSHHHHHH

SEQ ID NO: 901 - protein, 140 aa, Artificial Sequence
  Synthetic Sequence
QVQLQESGGGLVQPGGSLRLSCAASGFTFSSYGMSWVRQTPGKGPEWVSAIDSGGGSTSYADSVKGRFTISRDNAKNTLYLQMNSLKPEDTAVYYCAQGYYCSGYGCSDYWGQGTQVTVSSAAAYPYDVPDYGSHHHHHH

SEQ ID NO: 902 - protein, 142 aa, Artificial Sequence
  Synthetic Sequence
QVQLQESGGGLVQPGGSLRLSCAASGFNLDPYAIAWFRQAPGKEREEVSCISSSDVGTYYADSVKGRFTISRDNAKKTVYLQMNSLKPEDTAVYYCATDGYYYCSDYPHPLYWGQGTQVTVSSAAAYPYDVPDYGSHHHHHH

SEQ ID NO: 903 - protein, 145 aa, Artificial Sequence
  Synthetic Sequence
  misc_feature (13)..(13): Xaa can be any naturally occurring amino acid
QVQLQESGGGLVXAGGSLRLSCAASGRTFSISAMGWFRQAPGKEREFVAAITWSGGSTSYTDSVKGRFTISRDNAKNTLYLQMNSLKPEDTAIYYCAAMGRTNYGVIYDPNMYNYWGQGTQVTVSSAAAYPYDVPDYGSHHHHHH

SEQ ID NO: 904 - protein, 144 aa, Artificial Sequence
  Synthetic Sequence
QVQLQESGGGLVQPGGSLRLSCAASGFTLDYYAINWFRQAPGKEREEVSCISSSDGSTYYADSVKGRFTISRDNAKNTVYLQMNSLKPEDTAVYYCATSGWRLCRPTDEYDYLYWGQGTQVTVSSAAAYPYDVPDYGSHHHHHH

SEQ ID NO: 905 - protein, 140 aa, Artificial Sequence
  Synthetic Sequence
QVQLQESGGGLVQAGGSMRLSCAASGFTFSSYGMSWVRQTPGKGPEWVSAIDSGGGSTSYADSVKGRFTISRDNAKNTLYLQMNSLKPEDTAVYYCAQGYYCSGYGCSDYWGQGTQVTVSSAAAYPYDVPDYGSHHHHHH

SEQ ID NO: 906 - protein, 138 aa, Artificial Sequence
  Synthetic Sequence
QVQLQESGGGTVQAGGSLRLSCAASGFTFNDYAMSWVRQAPGKGLEWVSGIRSNGGYTNYADSVKGRFTISRDNAKNTLYLQMNSLKSEDTAVYYCAQGYYCSGYGCYPGQGTQVTVSSAAAYPYDVPDYGSHHHHHH

SEQ ID NO: 907 - protein, 143 aa, Artificial Sequence
  Synthetic Sequence
QVQLQESGGGLVQPGTSLRLSCAASGFTLDYYAIGWFRQAPGKEREEVSCISSSDGSTYYADSVKGRFTISRDNAKNTVNLQMNSLKPEDTAVYYCATDGWSSCRHGINEYLYWGQGTQVTVSSAAAYPYDVPDYGSHHHHHH

SEQ ID NO: 908 - protein, 119 aa, Artificial Sequence
  Synthetic Sequence
EVQLVESGGGLVQPGGSLRLSCAASGFTFSSYWMSWVRQAPGKGLEWVANIKQDGGEKYYVDSVKGRFTISRDNAKNSLFLQMNSLRAEDTAVYYCARVQLYSDYFDYWGQGTLVTVSS

SEQ ID NO: 909 - protein, 16 aa, Artificial Sequence
  Synthetic Sequence
AITSGGRLSYADSVKG

SEQ ID NO: 910 - protein, 17 aa, Artificial Sequence
  Synthetic Sequence
AINWRGGDTYYADSVKG

SEQ ID NO: 911 - protein, 145 aa, Artificial Sequence
  Synthetic Sequence
QVQLQESGGGSVQAGGSLRLSCAASGRTFSSYAMAWFRQAPGMERELVAAISWSGGSTYYADSVKGRFTISRDNAENTVYLQMNSLKPEDTAVYYCAAEAEGSGREGNFYERSWYQGQGTQVTVSSAAAYPYDVPDYGSHHHHHH

SEQ ID NO: 912 - protein, 146 aa, Artificial Sequence
  Synthetic Sequence
QVQLQESGGGLVQPGGSLRLSCSASGFSMDYYAIAWFRQAPGKEREEISCITGSDFMVDTYYVASVKGRFTISRDNAKNTAHLQMNSLKPEDTGVYFCAVRSTANTLCPSHYSVMDYWGKGTQVTVSSAAAYPYDVPDYGSHHHHH

SEQ ID NO: 913 - DNA, 20 bp, Artificial Sequence
  Synthetic Sequence
ttatgcttccggctcgtatg

SEQ ID NO: 914 - DNA, 29 bp, Artificial Sequence
  Synthetic Sequence
  misc_feature (24)..(24): "R" is G or A
gatgtgcagctgcaggagtctggrggagg

SEQ ID NO: 915 - DNA, 34 bp, Artificial Sequence
  Synthetic Sequence
ctagtgcggccgctgaggagacggtgacctgggt

SEQ ID NO: 916 - DNA, 22 bp, Artificial Sequence
  Synthetic Sequence
tcacacaggaaacagctatgac

SEQ ID NO: 917 - DNA, 24 bp, Artificial Sequence
  Synthetic Sequence
cgccagggttttcccagtcacgac

SEQ ID NO: 918 - protein, 11 aa, Artificial Sequence
  Synthetic Sequence
QGSMHSVNSMA

SEQ ID NO: 919 - DNA, 33 bp, Artificial Sequence
  Synthetic Sequence
ctagtgcggccgctgaggagacggtgacctggg

SEQ ID NO: 920 - protein, 18 aa, Artificial Sequence
  Synthetic Sequence
AAASGLGSVVVTANEYDY

SEQ ID NO: 921 - protein, 288 aa, Artificial Sequence
  Synthetic Sequence
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 922 - protein, 147 aa, Artificial Sequence
  Synthetic Sequence
QVQLQESGGGLVQPGGSLRLSCSASGFSVDYYAIAWFRQAPGKEREEISCITGSDFMVDTYYVASVKGRFTISRDNAKNTAYLQMNSLKPEDTGVYFCAVRSTANTLCPSHYSIMDYWGKGTQVTVSSAAAYPYDVPDYGSHHHHHH

SEQ ID NO: 923 - protein, 290 aa, Artificial Sequence
  Synthetic Sequence
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 924 - protein, 176 aa, Artificial Sequence
  Synthetic Sequence
MRIFAVFIFMTYWHLLNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 925 - protein, 178 aa, Artificial Sequence
  Synthetic Sequence
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGD

SEQ ID NO: 926 - protein, 453 aa, Artificial Sequence
  Synthetic Sequence
QVQLVQSGAEVKKPGSSVKVSCKTSGDTFSTYAISWVRQAPGQGLEWMGGIIPIFGKAHYAQKFQGRVTITADESTSTAYMELSSLRSEDTAVYFCARKFHFVSGSPFGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 927 - protein, 213 aa, Artificial Sequence
  Synthetic Sequence
EIVLTQSPATLSLSPGERATLSCRASQSVSSYLAWYQQKPGQAPRLLIYDASNRATGIPARFSGSGSGTDFTLTISSLEPEDFAVYYCQQRSNWPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 928 - protein, 297 aa, Artificial Sequence
  Synthetic Sequence
MTTPRNSVNGTFPAEPMKGPIAMQSGPKPLFRRMSSLVGPTQSFFMRESKTLGAVQIMNGLFHIALGGLLMIPAGIYAPICVTVWYPLWGGIMYIISGSLLAATEKNSRKCLVKGKMIMNSLSLFAAISGMILSIMDILNIKISHFLKMESLNFIRAHTPYINIYNCEPANPSEKNSPSTQYCYSIQSLFLGILSVMLIFAFFQELVIAGIVENEWKRTCSRPKSNIVLLSAEEKKEQTIEIKEEVVGLTETSSQPKNEEDIEIIPIQEEEEEETETNFPEPPQDQESSPIENDSSP

SEQ ID NO: 929 - protein, 333 aa, Artificial Sequence
  Synthetic Sequence
MESSGNPESTTFFYYDLQSQPCENQAWVFATLATTVLYCLVFLLSLVGNSLVLWVLVKYESLESLTNIFILNLCLSDLVFACLLPVWISPYHWGWVLGDFLCKLLNMIFSISLYSSIFFLTIMTIHRYLSVVSPLSTLRVPTLRCRVLVTMAVWVASILSSILDTIFHKVLSSGCDYSELTWYLTSVYQHNLFFLLSLGIILFCYVEILRTLFRSRSKRRHRTVKLIFAIVVAYFLSWGPYNFTLFLQTLFRTQIIRSCEAKQQLEYALLICRNLAFSHCCFNPVLYVFVGVKFRTHLKHVLRQFWFCRLQAPSPASIPHSPGAFAYEGASFY

SEQ ID NO: 930 - protein, 114 aa, Artificial Sequence
  Synthetic Sequence
MRLLILALLGICSLTAYIVEGVGSEVSDKRTCVSLTTQRLPVSRIKTYTITEGSLRAVIFITKRGLKVCADPQATWVRDVVRSMDRKSNTRNNMIQTKPTGTQQSTNTAVTLTG

SEQ ID NO: 931 - protein, 300 aa, Artificial Sequence
  Synthetic Sequence
ASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPA

SEQ ID NO: 932 - protein, 167 aa, Artificial Sequence
  Synthetic Sequence
MCDLPQTHSLGNRRALILLAQMRRISPFSCLKDRHDFGFPQEEFDGNQFQKAQAISVLHEMIQQTFNLFSTKDSSAAWDESLLEKFYTELYQQLNDLEACVIQEVGVEETPLMNVDSILAVKKYFQRITLYLTEKKYSPCAWEVVRAEIMRSFSLSTNLQERLRRKE

SEQ ID NO: 933 - protein, 166 aa, Artificial Sequence
  Synthetic Sequence
CDLPQTHSLGNRRALILLAQMRRISPFSCLKDRHDFGFPQEEFDGNQFQKAQAISVLHEMIQQTFNLFSTKDSSAAWDESLLEKFYTELYQQLNDLEACVIQEVGVEETPLMNVDSILAVKKYFQRITLYLTEKKYSPCAWEVVRAEIMRSFSLSTNLQERLRRKE

SEQ ID NO: 934 - protein, 166 aa, Artificial Sequence
  Synthetic Sequence
CDLPQTHSLGNRRTLMLLAQMRRISPFSCLKDRHDFGFPQEEFDGNQFQKAQAISVLHEMIQQTFNLFSTKDSSAAWDESLLEKFYTELYQQLNDLEACVIQEVGVEETPLMNVDSILAVKKYFQRITLYLTEKKYSPCAWEVVRAEIMRSFSLSTNLQERLRRKE

SEQ ID NO: 935 - protein, 166 aa, Artificial Sequence
  Synthetic Sequence
CDLPQTHSLGNRRALILLAQMRRISPFSCLKDRHDFGFPQEEFDGNQFQKAQAISVLHEMIQQTFNLFSTKDSSAAWDESLLEKFYTELYQQLNDLEACVIQEVGVEETPLMNEDSILAVRKYFQRITLYLTEKKYSPCAWEVVRAEIMRSFSLSTNLQERLRRKE

SEQ ID NO: 936 - protein, 167 aa, Artificial Sequence
  Synthetic Sequence
MCDLPQTHSLGNRRALILLAQMRRISPFSCLKDRHDFGFPQEEFDGNQFQKAQAISVLHEMIQQTFNLFSTKDSSAAWDESLLEKFYTELYQQLNDLEACVIQEVGVEETPLMNEDSILAVRKYFQRITLYLTEKKYSPCAWEVVRAEIMRSFSLSTNLQERLRRKE

SEQ ID NO: 937 - protein, 167 aa, Artificial Sequence
  Synthetic Sequence
MCDLPQTHSLGNRRALILLAQMRRISPFSCLKDRHDFGFPQEEFDGNQFQKAQAISVLHEMIQQTFNLFSTKDSSAAWDESLLEKFYTELYQQLNDLEACVIQEVGVEETPLMNEDSILAVRKYFQRITLYLTEKKYSPCAWEVVRAEIMRSFSLCTNLQERLRRKE

SEQ ID NO: 938 - protein, 504 aa, Artificial Sequence
  Synthetic Sequence
MEPAGPAPGRLGPLLCLLLAASCAWSGVAGEEELQVIQPDKSVLVAAGETATLRCTATSLIPVGPIQWFRGAGPGRELIYNQKEGHFPRVTTVSDLTKRNNMDFSIRIGNITPADAGTYYCVKFRKGSPDDVEFKSGAGTELSVRAKPSAPVVSGPAARATPQHTVSFTCESHGFSPRDITLKWFKNGNELSDFQTNVDPVGESVSYSIHSTAKVVLTREDVHSQVICEVAHVTLQGDPLRGTANLSETIRVPPTLEVTQQPVRAENQVNVTCQVRKFYPQRLQLTWLENGNVSRTETASTVTENKDGTYNWMSWLLVNVSAHRDDVKLTCQVEHDGQPAVSKSHDLKVSAHPKEQGSNTAAENTGSNERNIYIVVGVVCTLLVALLMAALYLVRIRQKKAQGSTSSTRLHEPEKNAREITQDTNDITYADLNLPKGKKPAPQAAEPNNHTEYASIQTSPQPASEDTLTYADLDMVHLNRTPKQPAPKPEPSFSEYASVQVPRK

SEQ ID NO: 939 - protein, 474 aa, Artificial Sequence
  Synthetic Sequence
EEELQVIQPDKSVLVAAGETATLRCTATSLIPVGPIQWFRGAGPGRELIYNQKEGHFPRVTTVSDLTKRNNMDFSIRIGNITPADAGTYYCVKFRKGSPDDVEFKSGAGTELSVRAKPSAPVVSGPAARATPQHTVSFTCESHGFSPRDITLKWFKNGNELSDFQTNVDPVGESVSYSIHSTAKVVLTREDVHSQVICEVAHVTLQGDPLRGTANLSETIRVPPTLEVTQQPVRAENQVNVTCQVRKFYPQRLQLTWLENGNVSRTETASTVTENKDGTYNWMSWLLVNVSAHRDDVKLTCQVEHDGQPAVSKSHDLKVSAHPKEQGSNTAAENTGSNERNIYIVVGVVCTLLVALLMAALYLVRIRQKKAQGSTSSTRLHEPEKNAREITQDTNDITYADLNLPKGKKPAPQAAEPNNHTEYASIQTSPQPASEDTLTYADLDMVHLNRTPKQPAPKPEPSFSEYASVQVPRK

SEQ ID NO: 940 - protein, 508 aa, Artificial Sequence
  Synthetic Sequence
MEPAGPAPGRLGPLLCLLLAASCAWSGVAGEEELQVIQPDKSVLVAAGETATLRCTATSLIPVGPIQWFRGAGPGRELIYNQKEGHFPRVTTVSDLTKRNNMDFSIRIGNITPADAGTYYCVKFRKGSPDDVEFKSGAGTELSVRAKPSAPVVSGPAARATPQHTVSFTCESHGFSPRDITLKWFKNGNELSDFQTNVDPVGESVSYSIHSTAKVVLTREDVHSQVICEVAHVTLQGDPLRGTANLSETIRVPPTLEVTQQPVRAENQVNVTCQVRKFYPQRLQLTWLENGNVSRTETASTVTENKDGTYNWMSWLLVNVSAHRDDVKLTCQVEHDGQPAVSKSHDLKVSAHPKEQGSNTAAENTGSNERNIYIVVGVVCTLLVALLMAALYLVRIRQKKAQGSTSSTRLHEPEKNAREITQVQSLDTNDITYADLNLPKGKKPAPQAAEPNNHTEYASIQTSPQPASEDTLTYADLDMVHLNRTPKQPAPKPEPSFSEYASVQVPRK

SEQ ID NO: 941 - protein, 503 aa, Artificial Sequence
  Synthetic Sequence
MEPAGPAPGRLGPLLCLLLAASCAWSGVAGEEELQVIQPDKSVLVAAGETATLRCTATSLIPVGPIQWFRGAGPGRELIYNQKEGHFPRVTTVSDLTKRNNMDFSIRIGNITPADAGTYYCVKFRKGSPDVEFKSGAGTELSVRAKPSAPVVSGPAARATPQHTVSFTCESHGFSPRDITLKWFKNGNELSDFQTNVDPVGESVSYSIHSTAKVVLTREDVHSQVICEVAHVTLQGDPLRGTANLSETIRVPPTLEVTQQPVRAENQVNVTCQVRKFYPQRLQLTWLENGNVSRTETASTVTENKDGTYNWMSWLLVNVSAHRDDVKLTCQVEHDGQPAVSKSHDLKVSAHPKEQGSNTAAENTGSNERNIYIVVGVVCTLLVALLMAALYLVRIRQKKAQGSTSSTRLHEPEKNAREITQDTNDITYADLNLPKGKKPAPQAAEPNNHTEYASIQTSPQPASEDTLTYADLDMVHLNRTPKQPAPKPEPSFSEYASVQVPRK

SEQ ID NO: 942 - protein, 5 aa, Artificial Sequence
  Synthetic Sequence
GGGSE

SEQ ID NO: 943 - protein, 5 aa, Artificial Sequence
  Synthetic Sequence
GSESG

SEQ ID NO: 944 - protein, 5 aa, Artificial Sequence
  Synthetic Sequence
GSEGS

SEQ ID NO: 945 - protein, 35 aa, Artificial Sequence
  Synthetic Sequence
GEGGSGEGSSGEGSSSEGGGSEGGGSEGGGSEGGS

SEQ ID NO: 946 - protein, 166 aa, Artificial Sequence
  Synthetic Sequence
MKYTSYILAFQLCIVLGSLGCYCQDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 947 - protein, 143 aa, Artificial Sequence
  Synthetic Sequence
QDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 948 - protein, 138 aa, Artificial Sequence
  Synthetic Sequence
QDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRG

SEQ ID NO: 949 - protein, 136 aa, Artificial Sequence
  Synthetic Sequence
QDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLF

SEQ ID NO: 950 - protein, 129 aa, Artificial Sequence
  Synthetic Sequence
QDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKR

SEQ ID NO: 951 - protein, 128 aa, Artificial Sequence
  Synthetic Sequence
QDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGK

SEQ ID NO: 952 - protein, 127 aa, Artificial Sequence
  Synthetic Sequence
QDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTG

SEQ ID NO: 953 - protein, 143 aa, Artificial Sequence
  Synthetic Sequence
QDPYVKEAENLKKYFNAGHSDAADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 954 - protein, 143 aa, Artificial Sequence
  Synthetic Sequence
QDPYVKEAENLKKYFNAGHSDVGDNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 955 - protein, 143 aa, Artificial Sequence
  Synthetic Sequence
QDPYVKEAENLKKYFNAGHSDVGGNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 956 - protein, 143 aa, Artificial Sequence
  Synthetic Sequence
QDPYVKEAENLKKYFNAGHSDVAGNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 957 - protein, 143 aa, Artificial Sequence
  Synthetic Sequence
QDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIAELIQVMAELSPAAKTGKRKRSQMLFRGRRASQ

SEQ ID NO: 958 - protein, 143 aa, Artificial Sequence
  Synthetic Sequence
QDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIDELIQVMAELSPAAKTGKRKRSQMLFRGRRASQ

SEQ ID NO: 959 - protein, 143 aa, Artificial Sequence
  Synthetic Sequence
QDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELAQVMAELSPAAKTGKRKRSQMLFRGRRASQ

SEQ ID NO: 960 - protein, 143 aa, Artificial Sequence
  Synthetic Sequence
QDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIAVMAELSPAAKTGKRKRSQMLFRGRRASQ

SEQ ID NO: 961 - protein, 143 aa, Artificial Sequence
  Synthetic Sequence
QDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMGELSPAAKTGKRKRSQMLFRGRRASQ

SEQ ID NO: 962 - protein, 143 aa, Artificial Sequence
  Synthetic Sequence
QDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELAQVMGELSPAAKTGKRKRSQMLFRGRRASQ

What is claimed is:

1. A chimeric protein comprising:
   (a) a modified human IFN-γ, said modified human IFN-γ having one or more mutations as compared to a wild type human IFN-γ, the mutations being selected from:
      (i) a truncation at the C-terminus of about 14, 15, or 16 amino acid residues and
      (ii) an A23G and D24G double substitution;
   (b) one or more targeting moieties, the targeting moieties comprising recognition domains which specifically bind to antigens or receptors of interest; and
   wherein the modified human IFN-γ and the one or more targeting moieties are optionally connected with one or more linkers.

2. The chimeric protein of claim 1, wherein the modified human IFN-γ exhibits reduced affinity and/or biological activity for IFN-γ receptor.

3. The chimeric protein of claim 2, wherein the modified human IFN-γ exhibits reduced affinity and/or biological activity for IFN-γ receptor 1 subunit or IFN-γ receptor 2 subunit.

4. The chimeric protein of claim 1, wherein the truncation at the C-terminus is 16 amino acid residues.

5. The chimeric protein of claim 1, wherein the truncation at the C-terminus is 15 amino acid residues.

6. The chimeric protein of claim 1, wherein the truncation at the C-terminus is 14 amino acid residues.

7. The chimeric protein of claim 1, wherein the modified human IFN-γ is a single chain IFN-γ.

8. The chimeric protein of claim 7, wherein the single chain IFN-γ comprises a first IFN-γ chain linked to a second IFN-γ chain.

9. The chimeric protein of claim 8, wherein the C-terminus of the first IFN-γ chain is linked to the N-terminus of the second IFN-γ chain.

10. The chimeric protein of claim 1, wherein the one or more mutations confer reduced affinity and/or biological activity that is restorable by attachment to one or more targeting moieties.

11. The chimeric protein claim 1, wherein the targeting moiety is directed against an immune cell selected from a T cell, a regulatory T cell (Treg), a B cell, a myeloid derived suppressor cell (MDSC), a dendritic cell, a macrophage, and a NK cell.

12. The chimeric protein claim 1, wherein the recognition domain is a single-domain antibody.

13. The chimeric protein claim 12, wherein the recognition domain is a $V_{HH}$, humanized $V_{HH}$, or camelized $V_{HH}$.

14. The chimeric protein claim 1, wherein the recognition domain functionally modulates the antigen or receptor of interest.

15. The chimeric protein of claim 1, comprising two or more targeting moieties.

16. The chimeric protein of claim 1, further comprising one or more additional modified signaling agents.

17. The chimeric protein of claim 16, wherein the additional modified signaling agent comprises one or more mutations conferring reduced affinity and/or biological activity for a receptor relative to a wild type signaling agent.

18. The chimeric protein of claim 17, wherein the one or more mutations confer reduced affinity and/or biological activity or activity that is restorable by attachment to one or more targeting moiety.

19. A recombinant nucleic acid composition encoding the chimeric protein of claim 1.

20. A host cell comprising a nucleic acid of claim 19.

21. A method for treating cancer, comprising administering an effective amount of the chimeric protein claim 1 to a patient in need thereof.

22. A method for treating an autoimmune disease or disorder, comprising administering an effective amount of the chimeric protein claim 1 to a patient in need thereof.

23. A chimeric protein comprising:
(a) a modified human IFN-γ, said modified human IFN-γ having one or more mutations as compared to a wild type human IFN-γ, the mutations being selected from:
(i) a truncation at the C-terminus of about 5 to about 20 amino acid residues and
(ii) an A23G and D24G double substitution;
(b) one or more targeting moieties, the targeting moieties comprising recognition domains which specifically bind to antigens or receptors of interest; and
wherein the modified human IFN-γ is a single chain IFN-γ comprising a first IFN-γ chain linked to a second IFN-γ chain, and
wherein the modified human IFN-γ and the one or more targeting moieties are optionally connected with one or more linkers.

24. The chimeric protein of claim 23, wherein the C-terminus of the first IFN-γ chain is linked to the N-terminus of the second IFN-γ chain.

25. The chimeric protein of claim 23, wherein the one or more mutations confer reduced affinity and/or biological activity that is restorable by attachment to one or more targeting moieties.

26. The chimeric protein claim 23, wherein the targeting moiety is directed against an immune cell selected from a T cell, a regulatory T cell (Treg), a B cell, a myeloid derived suppressor cell (MDSC), a dendritic cell, a macrophage, and a NK cell.

27. A chimeric protein comprising:
(a) a modified human IFN-γ, said modified human IFN-γ having one or more mutations as compared to a wild type human IFN-γ, the mutations being selected from:
(i) a truncation at the C-terminus of about 5 to about 20 amino acid residues and
(ii) an A23G and D24G double substitution;
(b) one or more targeting moieties, the targeting moieties comprising recognition domains which specifically bind to antigens or receptors of interest; and
wherein the modified human IFN-γ and the one or more targeting moieties are optionally connected with one or more linkers, and
wherein the chimeric protein comprises two or more targeting moieties and/or one or more additional modified signaling agents.

28. The chimeric protein of claim 27, wherein the additional modified signaling agent comprises one or more mutations conferring reduced affinity and/or biological activity for a receptor relative to a wild type signaling agent.

29. The chimeric protein of claim 28, wherein the one or more mutations confer reduced affinity and/or biological activity or activity that is restorable by attachment to one or more targeting moiety.

* * * * *